United States Patent
Barry et al.

(10) Patent No.: US 10,480,007 B2
(45) Date of Patent: Nov. 19, 2019

(54) INSECTICIDAL PROTEINS FROM PLANTS

(71) Applicants: PIONEER HI-BRED INTERNATIONAL, INC., Johnston, IA (US); E. I. DU PONT DE NEMOURS AND COMPANY, Wilmington, DE (US)

(72) Inventors: Jennifer Barry, Ames, IA (US); Kevin Hayes, Urbadale, IA (US); Lu Liu, Palo Alto, CA (US); Eric Schepers, Port Deposit, MD (US); Nasser Yalpani, Johnston, IA (US)

(73) Assignees: PIONEER HI-BRED INTERNATIONAL, INC. IA (US); E I DU PONT DE NEMOURS AND COMPANY, Wilmington, DE (US)

( * ) Notice: Subject to any disclaimer, the term of this patent is extended or adjusted under 35 U.S.C. 154(b) by 331 days.

(21) Appl. No.: 15/116,715

(22) PCT Filed: Feb. 6, 2015

(86) PCT No.: PCT/US2015/014816
§ 371 (c)(1),
(2) Date: Dec. 19, 2016

(87) PCT Pub. No.: WO2015/120270
PCT Pub. Date: Aug. 13, 2015

(65) Prior Publication Data
US 2017/0166921 A1  Jun. 15, 2017

Related U.S. Application Data

(60) Provisional application No. 61/937,288, filed on Feb. 7, 2014.

(51) Int. Cl.
| | |
|---|---|
| *C12N 15/82* | (2006.01) |
| *C07K 14/415* | (2006.01) |
| *A01N 63/02* | (2006.01) |
| *A01N 47/44* | (2006.01) |
| *A01N 65/00* | (2009.01) |
| *A01N 65/04* | (2009.01) |

(52) U.S. Cl.
CPC ......... *C12N 15/8286* (2013.01); *A01N 47/44* (2013.01); *A01N 63/02* (2013.01); *A01N 65/00* (2013.01); *C07K 14/415* (2013.01); *A01N 65/04* (2013.01); *C07K 2319/00* (2013.01); *Y02A 40/162* (2018.01)

(58) Field of Classification Search
CPC .................... C12N 15/8286; C07K 15/415
See application file for complete search history.

(56) References Cited

U.S. PATENT DOCUMENTS

2017/0233440 A1   8/2017  Barry et al.

FOREIGN PATENT DOCUMENTS

WO      2013098858 A2     7/2013

OTHER PUBLICATIONS

Guo et al (PNAS Jun. 22, 2004 vol. 101 No. 25 9205-9210) (Year: 2004).*
Evaluation of Fern and Moss Protein-Based Defenses Against Phytophagous Insects kevin Markham, Tanya Chalk, and C. Neal Stewart Jr. International Journal of Plant Sciences 2006 167:1, 111-117 (Year:2006).*
International Search Report and Written Opinion for International Application No. PCT/US2015/014816 completed Jul. 2, 2015.
Tamura, et al. "Purification, characterization and cDNA cloning of two natterin-like toxins from the skin secretion of oriental catfish *Plotosus lineatus*", TOXICON, vol. 58, No. 5: 430-438 (2011).
Abicht, et al. "Genome Sequence of *Desulfosporosinus* sp. OT, an Acidophilic Sulfate-Reducing Bacterium from Copper Mining Waste in Norilsk, Northern Siberia", Journal of Bacteriology, vol. 193, No. 21: 6104-6105 (2011).
UNIPROT Q5CZR5, Database Accession XP-002752299, May 1, 2007 (May 1, 2007).
UNIPROT F2ZAL6, Database Accession XP-002752298, Jun. 28, 2011 (Jun. 28, 2011).

* cited by examiner

*Primary Examiner* — Lee A Visone

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

6 Claims, 104 Drawing Sheets
Specification includes a Sequence Listing.

Fig. 3a

```
                       1                                                            60
PtIP-65Aa    (1)  ------------------------------------------------------------
PtIP-65Ba    (1)  ------------------------------------------------------------
PtIP-65Bb    (1)  ------------------------------------------------------------
PtIP-65Ca    (1)  ------------------------------------------------------------
PtIP-65Fa    (1)  ------------------------------------------------------------
PtIP-65Fb    (1)  ------------------------------------------------------------
PtIP-65Ga    (1)  ------------------------------------------------------------
PtIP-65Gb    (1)  ------------------------------------------------------------
PtIP-65Gc    (1)  ------------------------------------------------------------
PtIP-65Ha    (1)  ------------------------------------------------------------
PtIP-65Gd    (1)  ------------------------------------------------------------
PtIP-65Ge    (1)  ------------------------------------------------------------
PtIP-65Hj    (1)  ------------------------------------------------------------
PtIP-65Hg    (1)  MQYGLANTEASPLIEKFQALMEGGIDESILATKLVGAEGDASHLPPPGETPSEDGAGKDP
PtIP-65Hh    (1)  -------------------MAQLQQHVVNSKHAYGKHAPASKVCEIARAPVHAYKGSN-
PtIP-65Hb    (1)  ------------------------------------------------------------
PtIP-65Hc    (1)  ------------------------------------------------------------
PtIP-65Hd    (1)  ------------------------------------------------------------
PtIP-65He    (1)  ------------------------------------------------------------
PtIP-65Hf    (1)  ------------------------------------------------------------
PtIP-65Hk    (1)  ------------------------------------------------------------
```

Fig. 3b

```
                    61                                                    120
PtIP-65Aa   (1)  ---------------------MALVIGGLIGGQ-GGYA--FNYYGGTDGRVMQRIKVWA
PtIP-65Ba   (1)  ---------------------MALVISCPVGGQ-GGSF--FNYYGGTDGRVMQRIKVWA
PtIP-65Bb   (1)  ---------------------MALVIGWPVGGQ-GGSF--FNYYGGTDGRVMQRIKVWA
PtIP-65Ca   (1)  ---------------------MALVIGGLIGGG-GGSY--FSYYGGTDGRVMQRIRVWA
PtIP-65Fa   (1)  --------------------MAFQTPVTLIGASSGGQQ--FSAYGGTDGKLLEKIGVWA
PtIP-65Fb   (1)  --------------------MAFQTPVTLIGGSSGGQQ--FSAYGGTDGKLLEKIGVWA
PtIP-65Ga   (1)  -------------------MSLVQTPVYVIGGQ-GGNA--FSYDQSRNGRIIRRIGVWA
PtIP-65Gb   (1)  -------------------MSLVQTPVYVIGGQ-GGNA--FTYDQSRNGRIIRRIGVWA
PtIP-65Gc   (1)  -------------------MALYQTPVYVIGGQ-GGSS--FTYDQSRNGRVLTKIGVWA
PtIP-65Ha   (1)  -------------------MALYQTPVYVIGGQ-GGSS--FTYDQSRNGKVIRKIGVWA
PtIP-65Gd   (1)  -------------------MALYQTPVYVIGGQ-GGNS--FTYDQSRNGKVLTKIGVWA
PtIP-65Ge   (1)  -------------------MALYQTPVYVIGGQ-GGNS--FTYDQSRNGKVLTKIGVWA
PtIP-65Hj   (1)  -------------------MSIHQTPVTLIGGR-GGAA--FTYNAGASGRIIRRIGVWA
PtIP-65Hg  (61)  PNESLETEDVEEHADDSKARSASVTAPLRFIGGP-GGSQ--RSVRGWTNGRVITRMRVYR
PtIP-65Hh  (40)  ---------------QG------DVTAPLTFIGGD-GGKQ--VSKRAWESGKLITRLRVYS
PtIP-65Hb   (1)  -----------------MSLLTPHLLTASAGG-FIGGDI--FRHSGETDGRVLHRIRLSR
PtIP-65Hc   (1)  -----------------MSSLINPHLETIRYGGSFAGGSP--FRILGETEGRVLQRIRISR
PtIP-65Hd   (1)  -----------------MSSLINPHLESITYAGSFAGGSP--FRILGETQGRVLQRIRVSR
PtIP-65He   (1)  -----------------MANLLTPLYMQPVQLAGSVNTSLGLWRVSSETEGKVLKRIRVYR
PtIP-65Hf   (1)  ----------------MTSLLTPPYMQPIQSAGGLFSSF---IVSGETEGKVLQRIRVYR
PtIP-65Hk   (1)  ----------------MSSGSVIGGVTMVGGPYGSYQ---EVQAWQVGSYISRLTVYW
```

Fig. 3c

```
              121                                                          180
PtIP-65Aa  (36) ATSRIKAISVWLSDG---VERTFGDPSRPAGEGDLRTSEFRFNSGETVTSLSLWGNGAGT
PtIP-65Ba  (36) AASRIKAISVWLSDG---VQKTFGDPSRPAGEGDLRTSEFSFNTGETVTQLSLWGNGAGT
PtIP-65Bb  (36) ATSRIKAISVWLSDG---VQKTFGDPSRPSGEGDLETSEFSFKTGETVTQLSLWGNGAGT
PtIP-65Ca  (36) ATSRIKAISVWLSDG---VQRTFGDPSRPAGEGNLRSAEFSFNTGERVTRLSLWGNGIGT
PtIP-65Fa  (38) GDSRIKAIKVWLTD--EAAQLFGDPHD-PPGEGPLHYKEFAFQPAELITRLSLWGNGAGT
PtIP-65Fb  (38) GDSRIKAIKVWLTD--EAAQLFGDPHD-PPGEGPLLYKEFTFQPAELITRLSLWGNGAGT
PtIP-65Ga  (38) GEWQLRGIRVWMTG--TDTPATFGT-------ATGSYSEVTFTDGERITRLSLWGNGAGT
PtIP-65Gb  (38) GEWQLRGIRVWMTG--TDTPATFGT-------ATGSYSEYTFADGERITRLSLWGNGAGT
PtIP-65Gc  (38) GEWQLRGIRVWMSG--SDTPATFGS-------ASGSYSEYTFADGERITRLSLWGNGAGT
PtIP-65Ha  (38) GEWQLRGIRVWMSG--SDSPATFGS-------ASGSYSEYTFADGERITRLSLWGNGAGT
PtIP-65Gd  (38) GEWQLRGIRVWMSG--SDSPTTFGT-------ASGSYSEYTFAAGERITRLSLWGNGAGT
PtIP-65Ge  (38) GEWQLRGIRVWMSG--SDSPTTFGT-------ASGSYSEYTFAAGERITRLSLWGNGAGT
PtIP-65Hj  (38) GGSQLRGIRVWWTG--LDSPITYGTP------NVGSYQEFTFQDGERITSLSLWGNGAGT
PtIP-65Hg (118) ARGTIKAYQIWLT----DSAPQTHGVP------GNSDFAEYTFRTGERLTRLTLWGNGMGT
PtIP-65Hh  (77) GYSCIKAMKVWFTGDEYSEGTCLGEP------DGTDYKEYTFSEGERITRMSLWGNGNGT
PtIP-65Hb  (41) EVARISAVEFWLTG--NSTPYVYGTPR------ADNSSYEFVDGERITRLDFRTHLFGV
PtIP-65Hc  (43) MANAIDAIEFWLTG--DSTPRVYGTVR------SENSSFDFSEGERITGLRFRNALFGI
PtIP-65Hd  (43) IATRIEAIEFWLTG--DSTPRVYGTVR------SENSSYDFAEGERITRLRFRTSRFGF
PtIP-65He  (45) LTRSIPAIEVWLTG--DSNPHVCGTPGR-----AESSTFEFSEGERITTLVLQDAQNIP
PtIP-65Hf  (42) FSRNIAAIEVWLTG--DSNPHLCGTPGR-----AESSTFEFSEGERITTLELQEDPQLP
PtIP-65Hk  (40) ESMRVRGARVWVKG--QSASTTFGD--------ATGSSADFEFETGETITAMSLWQGEWEN
```

Fig. 3d

```
                    181                                                        240
PtIP-65Aa   (93)  R-------SGWIYFRTSQNRTFDFGMYSWGKKTEYPQSVASGIWVGIRGR--ASSDIDAL
PtIP-65Ba   (93)  R-------SGWIYFRTNQNRTFDFGMYSWGKKTEYPQDVSSGIWVGITGR--AKSDVDAL
PtIP-65Bb   (93)  R-------SGWLYFRTSHNRTFDFGMYSWGKKTEYPQNVASGIWVGITGR--ASSDLDGL
PtIP-65Ca   (93)  R-------SGWIYFETNQGRRFDFGMYSWGKQTEFPQTVASGIWVGFTGR--ASLDVDAL
PtIP-65Fa   (95)  R-------AGWIYFETNQSRSFDFGMYSWGKKKEYPVDVASGICAGVMGT--AASDINNI
PtIP-65Fb   (95)  R-------AGWIYFETNRSRSFDFGMYSWGKKKEYPVDVASGICAGVMGT--AASDINNI
PtIP-65Ga   (89)  R-------SGGIRFYTTTGGSFFHKMTSWGLQTEYPIDVASGLCVGITGR--ANVDVDSL
PtIP-65Gb   (89)  R-------SGGIRFYTTTGGSFFHKMTSWGLQTEYPIDVASGLCVGIMGR--ANVDVDSL
PtIP-65Gc   (89)  R-------SGAIRFYTTTGGSFFPKMTSWGLQTEYPIDVASGLCVGILGR--ANVDVDSL
PtIP-65Ha   (89)  R-------SGAIRFYTTTGGSFFPKMTSWGLKTEYPMDVASGLCVGILGR--ANVDVDSL
PtIP-65Gd   (89)  R-------SGAIRFYTTTGGSFFPKMTSWDLKTEYPIDVASGLCVGIIGR--ASADIDSL
PtIP-65Ge   (89)  R-------SGAIRFYTTTGGSFFPKMTSWDLKTEYPIDVASGLCVGIIGR--ASADIDSL
PtIP-65Hj   (90)  R-------SGGIRFYTTTGRRFFHHMTSWGLKQEYPVDVVDGVCVGLTGR--QGADIDAL
PtIP-65Hg  (169)  R-------AGWIEFETSLGGRFSYGMSHWSLRTPYPVDVGSGILVGYIFN--AGEDVDAH
PtIP-65Hh  (131)  R-------AGWISLSTNKGGVFSYGMHGWPLCTEYPVNVGSGILAGAIYN--AGCDIDAH
PtIP-65Hb   (92)  V-TIQWDNIARVRFSTSRGRIFEFGSSREPSGQWFTANVGSGVCVGMSGV-EANGALTRL
PtIP-65Hc   (94)  G-QNQWNHVARVWFSTSRGRTFEYGSTREPTGQWFEVNVGSGVCVGVAGN-VMLNSLNML
PtIP-65Hd   (94)  GVQTQWDHVARVWFSTSRGRTFEYGSTREPSGQWFEANVGSGVCVGVAGN-VMLDSLNML
PtIP-65He   (97)  ------THVGRIRFQTSLLRTFEYGMSVQPTGKVTTVNVGSGVCVGVRASHSSTYGISVF
PtIP-65Hf   (94)  Y-----TVVGRIRFQTSRLRTFEYGMSVQPSGRVITVNVGSGVCVGVRAG-TALSVISIL
PtIP-65Hk   (91)  P---DHIRAGHLYFTTSNGREFSAGPS---TMWSETVIDVQSGWLVGLQAY--TGDDINKW
```

Fig. 3e

```
            241                                                         300
PtIP-65Aa (144) GVVFLQ-RIQSCRLTSVQYPTLQFSGSSGGTTSIVRTTPTKSFNLGNTADQDDPSS-TEQ
PtIP-65Ba (144) GVVFLQ-PILSCRLISVDYPTLQFSGTSGGTTSINLTTAGKTFNLQNAAHQEDPSS-TEK
PtIP-65Bb (144) GVVFLR-SIQSCRLINVQYPTLQFSGTAGGTTSITRTTAAKTFNLQNTANQDDPSS-TEQ
PtIP-65Ca (144) GVVFLR-PIQSCQLMNVQYPTLQFSGSSGATSITPTASSTKSFTLLNTADHEDQSS-TQQ
PtIP-65Fa (146) GFVFLK-PIQSSKLINVQYPSLSFDTQG-----------ISPQTLKEFNHTNTS--NNP
PtIP-65Fb (146) GFVFLK-PIQSSKLINVQYPSLSFDTQG-----------ISPQTLKEFNHTNTS--NNP
PtIP-65Ga (140) GVLFLR-TIAPARMINVSYPTLGLEQAG-----------IIPVTLDSYNDSNNAG-TIS
PtIP-65Gb (140) GVLFLR-TIASARMINVSYPTLGLEQAG-----------IIPVTLDSFNDSNNAG-TIS
PtIP-65Gc (140) GFLFLR-TIASARMINVSYPTLGLEQAG-----------IIPITLDSYNDSNNAG-AIS
PtIP-65Ha (140) GFLFLR-TIASARMINVSYPTLGLEQAG-----------IIPITLDSYNDSNNAG-AIS
PtIP-65Gd (140) GFMFLR-TIASSRMINVSYPTLGLEQAG-----------IIPVTLDSYNDSNNAG-SIS
PtIP-65Ge (140) GFMFLR-TIASSRMINVSYPTLGLEQAG-----------IIPVTLDSYNDSNNAG-SIS
PtIP-65Hj (141) GFMFLR-TMTSARMINVKYPTLGLETAG-----------IVPVTLDFMSDSNNAS-SIS
PtIP-65Hg (220) GFWFLN-HIEQAELTNVRYPTLGFDTAG-----------IVPTALDTFRFRNNS--STP
PtIP-65Hh (182) GYYFLSSSVTSSKLENVKYPTLKFDTSG-----------ITPVSLDTYKQTNTS--SSP
PtIP-65Hb (150) GFMFLR-SIQSVGFSSVEYPTLSTST----------ILTTPILEQLPDTFKSNDD-DEP
PtIP-65Hc (152) GFVFLR-SIQSVGFSSVEYPMFSTS-----------ITRTSILEQLPDTFKSNDD-DEP
PtIP-65Hd (153) GFVFLR-SIQRVGFTSVEYPTISSS-----------IARTFILSHLPDTFKSNDD-DEP
PtIP-65He (151) GFMFLR-PIQSVRLHGVVYPTISSTS----------TITTTILQELPATIKNDND-HEP
PtIP-65Hf (148) GFMFLR-PIRSVRLHGVVYPTISSIS----------TITTTILQELPATLKNDDD-HEP
PtIP-65Hk (144) GFVFLK-PLLVFALADVQYTGLQDVG-----------AIVPTTLDSLDETNNSSTGSD
```

Fig. 3f

```
              301                                                         360
PtIP-65Aa (202) LAWQLADEPSFDNVSHSWSLSNTSTGLLQ-----FIATSTVSVQARTPALAVVN------
PtIP-65Ba (202) LAWELADEPSFDNVSHTWSLSNISTRLLQ-----FISTSTISVQARTPALAVVN-----N
PtIP-65Bb (202) LAWQLADEPSFDNVSHTWSLSNTSTGLLQ-----FISTSTISVQARTPALTIVN------
PtIP-65Ca (202) LAWELADEPRFDNVFLSWILSNPSAGLLQ-----FITTSSISVQARIPALAVVN------
PtIP-65Fa (191) TNWEFKGS-SAVTVSSSWSLTTG-----------LAVHASVTVEAGIPAVADVS------
PtIP-65Fb (191) TSWEFKGS-SAVTVSSSWSLTTG-----------LAVHASVTVEAGIPAVADVS------
PtIP-65Ga (186) KNWTFSGS-RTVTISSSWSLTSG-----------IETHASVSVQAGIPMVAEVS------
PtIP-65Gb (186) KNWTFSGS-RTVTISSSWSLTSG-----------IETHASVSVQAGIPMVAEVS------
PtIP-65Gc (186) KNWTFSGS-RTVTISSSWTLTTG-----------IEAHASVTVQAGIPSVAEVS------
PtIP-65Ha (186) KNWTFSGS-RTVTISSSWTLTTG-----------IEAHASVTVQAGIPSVAEVS------
PtIP-65Gd (186) KNWTFSGS-RTVTISSSWTLTSG-----------IEAHASVTVQAGIPSVAEVS------
PtIP-65Ge (186) KNWTFSGS-RTVTISSSWTLTSG-----------IEAHASVTVQAGLPSVAEVS------
PtIP-65Hj (187) KTWSFQGS-REVTVSSSWSTTTG-----------IELHASITVSAGIPLVANVE------
PtIP-65Hg (265) RDWDFSRN-MSRSTERTWSITVD-----------LTVHASITVSAGFPGIANVS------
PtIP-65Hh (228) RNWSFGGK-RTVKSTTKWGLKIA-----------NTFNVELSVEAGVPQVSKSG------
PtIP-65Hb (197) LHVVLAGS-RQLETTSTW---TSPAVGLLSHLTGNDITVNVSLGINTPTVVPSG-PEGAS
PtIP-65Hc (198) LQMVLAGS-RQFKTSSTWR-VSSPTVGLLSHLTGNNILVDVTLGINTPTVVPTG-LAGAS
PtIP-65Hd (199) LQMVLAGS-RQFKTTSTWR-AQSPAVGLLSHLTANNITLDLTLGINTPTVVPTG-TAGAS
PtIP-65He (198) LHWVLAGS-RQCITSSTWRTQPADREGLVSHLVGRAISINIDLGIDTPKIVATGGTAGAS
PtIP-65Hf (195) LHWVLAGS-RQCFTSSTWRTQLAYRAGLVSHLVGSAISINMDLGIDAPKIVATGGTAGAS
PtIP-65Hk (190) VNWSLEGS-KAETVSWSFSTTDS-----------LTATIGFEVSAGIPEVAQVK------
```

Fig. 3g

```
                    361                                                      420
PtIP-65Aa  (251)  DVVGWQLSASDTQSSSLSSSSSLLLPWSR---------SGSLLPSK-SFALSALPY-RGN
PtIP-65Ba  (252)  IVVGWQLSASDTESSSLSSSSSLLLPWSR---------NGSLLPSE-SLTLSALPF-GGT
PtIP-65Bb  (251)  DVVGWLPSDSDTQSSSLSSSSSLLLPWSR---------NGSLLPSE-SLTISALPY-DGI
PtIP-65Ca  (251)  NVVGWQLSASDTQSSSLSSSSSLSLPWSR---------SGSLLPSQSLTTISALTY-RGD
PtIP-65Fa  (233)  GEFGWEVSASTTSQS--STTETDTLSWGV---------SGTLSAGE-SIHLKALTR-KGL
PtIP-65Fb  (233)  GEFGWEVSASTTSES--STTETDTLSWGV---------SGTLSAGE-SIHLKALTR-KGL
PtIP-65Ga  (228)  GEFGWSVSVSGTYAT--TQEESRTLTWNQ---------SGTLEPGQ-WISLQATTR-RGT
PtIP-65Gb  (228)  GEFGWSVSVSGTYAT--TQEESRTLTWNQ---------SGTLEPGQ-WISLQATTR-RGT
PtIP-65Gc  (228)  GEFGWSVSVTGSYTS--TQEESRTLTWNQ---------SGTLEPGQ-WISIQATTR-RGT
PtIP-65Ha  (228)  GEFGWSVSVTGSYTS--TQEESRTLTWNQ---------SGTLEPGQ-WISIQATTR-RGT
PtIP-65Gd  (228)  GEFGWSVSVSGSYTS--TQEESRTLTWNQ---------SGTLEPGQ-WISIQATTR-RGT
PtIP-65Ge  (228)  GEFGWSVSVSGSYTS--TQEESRTLTWNQ---------SGTLEPGQ-WISIQATTR-RGT
PtIP-65Hj  (229)  GQYGWAISTSSTYTT--NHSETRTLQWQN---------SGVLEPGQ-WISLQALTR-RGT
PtIP-65Hg  (307)  GQYGWEIGVTGHFET--TETSEHDLSWSV---------GGRVQPGD-VVDLTALTR-TGT
PtIP-65Hh  (270)  AKFGWTISVASDHEE--SEERTQELVWST---------GGTLQPGE-TVDLVALTR-QGN
PtIP-65Hb  (252)  TTFHWQTVRTFPSSN-AMEGSIANLTVTTNEYSVWCHISDTIAPAQLLP-KHVALVGEGR
PtIP-65Hc  (255)  TTFQWETVRAFPSTN-AIQGSISNLTVSTDEYSVWCHISDTVAPAQSLP-KHAAWVGEGR
PtIP-65Hd  (256)  TAFQWQTVRTFPSINAEIQGTIANLTVSTAEYSVWCHISDTVAPAQSIP-KHSAWVGEGR
PtIP-65He  (257)  TNFGWETARTFPSTN-AVEGSIADLTVRTNEYSVWGHVSDTLAPAQSLISRRAVLIGEGS
PtIP-65Hf  (254)  TNFGWETARTFPSTN-AIQGSIADLIVSTNAYSVWGHVSDTLAPAQSLISRRAALIGEGR
PtIP-65Hk  (232)  ESFQFQVGTSTTRSS--SYSEEHTLTWST---------GGVLKPGQ-HVVASAVTQ-VGT
```

Fig. 3h

```
                      421                                                        480
PtIP-65Aa  (300) VSGLSFNGSARVTTSGG-----TFSFSGLQGRFTGQSYAIDITTQ---------------
PtIP-65Ba  (301) VSGLPFDGSARVTTTGG-----TFSFSGLHGFYTGQSHVIAITTQ---------------
PtIP-65Bb  (300) VNGLPFTGSARVTTSHG-----TFSFSGLKGAFTGESHVIAVTAQ---------------
PtIP-65Ca  (301) ARNLFFNGSAQVTTTTGS----RFSFPGLQGLFTGQSYVPAITSQ---------------
PtIP-65Fa  (280) IS-VPYIGSIQVTLKSG-----DVFQYPLKGQYSGISYSGVTVT----------------
PtIP-65Fb  (280) IS-VPYTGSIQVTLKSG-----DIFQYPLKGQFSGVSYSGVTVT----------------
PtIP-65Ga  (275) IT-LPFQATMEITLLSG-----TIFQYAISSMYSGVDYTSVDITNTGTRASD---------
PtIP-65Gb  (275) IT-LPFQATMEITLLSG-----TIFQYAISSMYSGVDYTSVDITNTGTRASD---------
PtIP-65Gc  (275) IT-LPYQGTMEITLQSG-----TVFRYPISSMYSGVDYTSVDITNTGTRALKN--------
PtIP-65Ha  (275) IT-LPYQGTMEITLQSG-----TVFRYPISSMYSGVDYTSVDITNTGTRALKN--------
PtIP-65Gd  (275) IT-LPYQGTMEITLQSG-----TVFQYPISSMYSGVDYTSVDITNTGTRALK---------
PtIP-65Ge  (275) IT-LPYQGTMEITLQSG-----TVFQYPISSMYSGVDYTSVDITNTGTRALK---------
PtIP-65Hj  (276) IT-LPYQATMQITLQNG-----TVFTYPITAQYAGVDYTSVEIVSQGTRDLGSDHLAINK
PtIP-65Hg  (354) LN-IPYEGTMVVRMRNG-----ASFSYAVRGTYRGLSYTGTKINDNST------------
PtIP-65Hh  (317) LNDLRFEGTMVVTLKNG-----ASFRFPLSGPYKGICYTGVEIKDHEETKTMAMKSYASL
PtIP-65Hb  (310) ITALPCSARIQVLTSSAYDLPFATFSFPVQSLYNGRAHSQVQIIDP--------------
PtIP-65Hc  (313) ITALPCSANIQVFTSGGNNFPFGTFSFPVRLLYDGGAHSNVQVL----------------
PtIP-65Hd  (315) ITALPCSANIQVITSGGNNLPFASFSFPVRLFYDGGAHSTVQVL----------------
PtIP-65He  (316) IDNLQCSARIQVFTDADGGLPFATFTFPVGVLYSARAHSDVQVLS---------------
PtIP-65Hf  (313) IDNLQCSARIQVFTN-DSALSLATFTFPVGVLYSARAHSDVQVLS---------------
PtIP-65Hk  (279) LSGLPYTATVVIKTKDAS-----SYSYATSGSYSGISCTEVQLDVKVT------------
```

Fig. 3i

```
                481                                                           540
PtIP-65Aa (340) ------------------------------------------------------------
PtIP-65Ba (341) ------------------------------------------------------------
PtIP-65Bb (340) ------------------------------------------------------------
PtIP-65Ca (342) ------------------------------------------------------------
PtIP-65Fa (318) ------------------------------------------------------------
PtIP-65Fb (318) ------------------------------------------------------------
PtIP-65Ga (321) ------HVEVEATEQQVQGVKDQSVQPNKEAKECTLLFAE--------------------
PtIP-65Gb (321) ------HVEVEATEQQVQGVKDQSVQPNKEAKECTLLFAE--------------------
PtIP-65Gc (322) ------EVEVEAVDQQSQ-EGDHNVQPNKEVQESKLLFIE--------------------
PtIP-65Ha (322) ------EVEVEAVDQQSQ-EGDHNVQPNKEVQESKVLFIE--------------------
PtIP-65Gd (321) ------QVEVQATDQQSQ-EGDHNVQPDKEVEERKVLFTE--------------------
PtIP-65Ge (321) ------QVEVQATDQQSQ-EGDHNVQPDKEVEERKVLFTE--------------------
PtIP-65Hj (330) DVRYIAAANGAAVGTTTTNAPPHYVHPIRGAPIVEPVKFSVGATYINDTDNITQEVDTTA
PtIP-65Hg (396) ------------------------------------------------------------
PtIP-65Hh (372) CL----------------------------------------------------------
PtIP-65Hb (356) ------------------------------------------------------------
PtIP-65Hc (357) ------------------------------------------------------------
PtIP-65Hd (359) ------------------------------------------------------------
PtIP-65He (361) ------------------------------------------------------------
PtIP-65Hf (357) ------------------------------------------------------------
PtIP-65Hk (322) ------------------------------------------------------------
```

Fig. 4a

```
              1                                                   50
PtIP-65Aa  (1) MALVIGGLIGGQGGYAFNYYGGTDGRVMQRIKVWAATSRIKAISVWLSDG
PtIP-65Ba  (1) MALVISCPVGGQGGSFFNYYGGTDGRVMQRIKVWAAASRIKAISVWLSDG
PtIP-65Bb  (1) MALVIGWPVGGQGGSFFNYYGGTDGRVMQRIKVWAATSRIKAISVWLSDG
PtIP-65Ca  (1) MALVIGGLIGGGGGSYFSYYGGTDGRVMQRIRVWAATSRIKAISVWLSDG 51                                                 100
PtIP-65Aa (51) VERTFGDPSRPAGEGDLRTSEFRFNSGETVTSLSLWGNGAGTRSGWIYFR
PtIP-65Ba (51) VQKTFGDPSRPAGEGDLRTSEFSFNTGETVTQLSLWGNGAGTRSGWIYFR
PtIP-65Bb (51) VQKTFGDPSRPSGEGDLETSEFSFKTGETVTQLSLWGNGAGTRSGWLYFR
PtIP-65Ca (51) VQRTFGDPSRPAGEGNLRSAEFSFNTGERVTRLSLWGNGIGTRSGWIYFE 101                                                150
PtIP-65Aa (101) TSQNRTFDFGMYSWGKKTEYPQSVASGIWVGIRGRASSDIDALGVVFLQR
PtIP-65Ba (101) TNQNRTFDFGMYSWGKKTEYPQDVSSGIWVGITGRAKSDVDALGVVFLQP
PtIP-65Bb (101) TSHNRTFDFGMYSWGKKTEYPQNVASGIWVGITGRASSDLDGLGVVFLRS
PtIP-65Ca (101) TNQGRRFDFGMYSWGKQTEFPQTVASGIWVGFTGRASLDVDALGVVFLRP 151                                                200
PtIP-65Aa (151) IQSCRLTSVQYPTLQFSGSSGGTTSIVRTTPTKSFNLGNTADQDDPSSTE
PtIP-65Ba (151) ILSCRLISVDYPTLQFSGTSGGTTSINLTTAGKTFNLQNAAHQEDPSSTE
PtIP-65Bb (151) IQSCRLINVQYPTLQFSGTAGGTTSITRTTAAKTFNLQNTANQDDPSSTE
PtIP-65Ca (151) IQSCQLMNVQYPTLQFSGSSGATSITPTASSTKSFTLLNTADHEDQSSTQ
```

Fig. 4b

```
                  201                                                250
PtIP-65Aa  (201)  QLAWQLADEPSFDNVSHSWSLSNTSTGLLQFIATSTVSVQARTPALAVVN
PtIP-65Ba  (201)  KLAWELADEPSFDNVSHTWSLSNISTRLLQFISTSTISVQARTPALAVVN
PtIP-65Bb  (201)  QLAWQLADEPSFDNVSHTWSLSNTSTGLLQFISTSTISVQARTPALTIVN
PtIP-65Ca  (201)  QLAWELADEPRFDNVFLSWILSNPSAGLLQFITTSSISVQARIPALAVVN 251                                                300
PtIP-65Aa  (251)  -DVVGWQLSASDTQSSSLSSSSSLLLPWSRSGSLLPSK-SFALSALPYRG
PtIP-65Ba  (251)  NIVVGWQLSASDTESSSLSSSSSLLLPWSRNGSLLPSE-SLTLSALPFGG
PtIP-65Bb  (251)  -DVVGWLPSDSDTQSSSLSSSSSLLLPWSRNGSLLPSE-SLTLSALPYDG
PtIP-65Ca  (251)  -NVVGWQLSASDTQSSSLSSSSSLSLPWSRSGSLLPSQSLTTLSALTYRG 301                                        342
PtIP-65Aa  (299)  NVSGLSFNGSARVTTSGG-TFSFSGLQGRFTGQSYAIDITTQ
PtIP-65Ba  (300)  TVSGLPFDGSARVTTTGG-TFSFSGLHGFYTGQSHVIAITTQ
PtIP-65Bb  (299)  IVNGLPFTGSARVTTSHG-TFSFSGLKGAFTGESHVIAVTAQ
PtIP-65Ca  (300)  DARNLFFNGSAQVTTTTGSRFSFPGLQGLFTGQSYVPAITSQ
```

Fig. 5a

```
                1                                                    50
PtIP-65Ga   (1) MSLVQTPVYVIGGQGGNAFSYDQSRNGRILRRIGVWAGEWQLRGIRVWMT
PtIP-65Gb   (1) MSLVQTPVYVIGGQGGNAFTYDQSRNGRILRRIGVWAGEWQLRGIRVWMT
PtIP-65Gc   (1) MALYQTPVYVIGGQGGSSFTYDQSRNGRVLTKIGVWAGEWQLRGIRVWMS
PtIP-65Gd   (1) MALYQTPVYVIGGQGGNSFTYDQSRNGKVLTKIGVWAGEWQLRGIRVWMS
PtIP-65Ge   (1) MALYQTPVYVIGGQGGNSFTYDQSRNGKVLTKIGVWAGEWQLRGIRVWMS
PtIP-65Ha   (1) MALYQTPVYVIGGQGGSSFTYDQSRNGKVLRKIGVWAGEWQLRGIRVWMS 51                                                   100
PtIP-65Ga  (51) GTDTPATFGTATGSYSEYTFTDGERITRLSLWGNGAGTRSGGIRFYTTTG
PtIP-65Gb  (51) GTDTPATFGTATGSYSEYTFADGERITRLSLWGNGAGTRSGGIRFYTTTG
PtIP-65Gc  (51) GSDTPATFGSASGSYSEYTFADGERITRLSLWGNGAGTRSGAIRFYTTTG
PtIP-65Gd  (51) GSDSPTTFGTASGSYSEYTFAAGERITRLSLWGNGAGTRSGAIRFYTTTG
PtIP-65Ge  (51) GSDSPTTFGTASGSYSEYTFAAGERITRLSLWGNGAGTRSGAIRFYTTTG
PtIP-65Ha  (51) GSDSPATFGSASGSYSEYTFADGERITRLSLWGNGAGTRSGAIRFYTTTG 101                                                  150
PtIP-65Ga (101) GSFFHKMTSWGLQTEYPIDVASGLCVGITGRANVDVDSLGVLFLRTIAPA
PtIP-65Gb (101) GSFFHKMTSWGLQTEYPIDVASGLCVGIMGRANVDVDSLGVLFLRTIASA
PtIP-65Gc (101) GSFFPKMTSWGLQTEYPIDVASGLCVGILGRANVDVDSLGFLFLRTIASA
PtIP-65Gd (101) GSFFPKMTSWDLKTEYPIDVASGLCVGIIGRASADIDSLGFMFLRTIASS
PtIP-65Ge (101) GSFFPKMTSWDLKTEYPIDVASGLCVGIIGRASADIDSLGFMFLRTIASS
PtIP-65Ha (101) GSFFPKMTSWGLKTEYPMDVASGLCVGILGRANVDVDSLGFLFLRTIASA
```

Fig. 5b

```
              151                                                200
PtIP-65Ga (151) RMINVSYPTLGLEQAGIIPVTLDSYNDSNNAGTISKNWTFSGSRTVTISS
PtIP-65Gb (151) RMINVSYPTLGLEQAGIIPVTLDSFNDSNNAGTISKNWTFSGSRTVTISS
PtIP-65Gc (151) RMINVSYPTLGLEQAGIIPITLDSYNDSNNAGAISKNWTFSGSRTVTISS
PtIP-65Gd (151) RMINVSYPTLGLEQAGIIPVTLDSYNDSNNAGSISKNWTFSGSRTVTISS
PtIP-65Ge (151) RMINVSYPTLGLEQAGIIPVTLDSYNDSNNAGSISKNWTFSGSRTVTISS
PtIP-65Ha (151) RMINVSYPTLGLEQAGIIPITLDSYNDSNNAGAISKNWTFSGSRTVTISS 201                                                250
PtIP-65Ga (201) SWSLTSGIETHASVSVQAGIPMVAEVSGEFGWSVSVSGTYATTQEESRTL
PtIP-65Gb (201) SWSLTSGIETHASVSVQAGIPMVAEVSGEFGWSVSVSGTYATTQEESRTL
PtIP-65Gc (201) SWTLTTGIEAHASVTVQAGIPSVAEVSGEFGWSVSVTGSYTSTQEESRTL
PtIP-65Gd (201) SWTLTSGIEAHASVTVQAGIPSVAEVSGEFGWSVSVSGSYTSTQEESRTL
PtIP-65Ge (201) SWTLTSGIEAHASVTVQAGLPSVAEVSGEFGWSVSVSGSYTSTQEESRTL
PtIP-65Ha (201) SWTLTTGIEAHASVTVQAGIPSVAEVSGEFGWSVSVTGSYTSTQEESRTL 251                                                300
PtIP-65Ga (251) TWNQSGTLEPGQWISLQATTRRGTITLPFQATMEITLLSGTIFQYAISSM
PtIP-65Gb (251) TWNQSGTLEPGQWISLQATTRRGTITLPFQATMEITLLSGTIFQYAISSM
PtIP-65Gc (251) TWNQSGTLEPGQWISIQATTRRGTITLPYQGTMEITLQSGTVFRYPISSM
PtIP-65Gd (251) TWNQSGTLEPGQWISIQATTRRGTITLPYQGTMEITLQSGTVFQYPISSM
PtIP-65Ge (251) TWNQSGTLEPGQWISIQATTRRGTITLPYQGTMEITLQSGTVFQYPISSM
PtIP-65Ha (251) TWNQSGTLEPGQWISIQATTRRGTITLPYQGTMEITLQSGTVFRYPISSM
```

Fig. 5c

```
              301                                                350
PtIP-65Ga (301) YSGVDYTSVDITNTGTRASD-HVEVEATEQQVQGVKDQSVQPNKEAKECT
PtIP-65Gb (301) YSGVDYTSVDITNTGTRASD-HVEVEATEQQVQGVKDQSVQPNKEAKECT
PtIP-65Gc (301) YSGVDYTSVDITNTGTRALKNEVEVEAVDQQSQ-EGDHNVQPNKEVQESK
PtIP-65Gd (301) YSGVDYTSVDITNTGTRALK-QVEVQATDQQSQ-EGDHNVQPDKEVEERK
PtIP-65Ge (301) YSGVDYTSVDITNTGTRALK-QVEVQATDQQSQ-EGDHNVQPDKEVEERK
PtIP-65Ha (301) YSGVDYTSVDITNTGTRALKNEVEVEAVDQQSQ-EGDHNVQPNKEVQESK

351
PtIP-65Ga (350) LLFAE
PtIP-65Gb (350) LLFAE
PtIP-65Gc (350) LLFIE
PtIP-65Gd (349) VLFTE
PtIP-65Ge (349) VLFTE
PtIP-65Ha (350) VLFIE
```

Fig. 6a

```
                    1                                                50
PtIP-65Hb     (1)   M-SLLTPHLLTASAGG-FIGGDI--FRHSGETDGRVLHRIRLSREVARIS
PtIP-65Hc     (1)   MSSLINPHLETIRYGGSFAGGSP--FRILGETEGRVLQRIRISRMANAID
PtIP-65Hd     (1)   MSSLINPHLESITYAGSFAGGSP--FRILGETQGRVLQRIRVSRIATRIE
PtIP-65He     (1)   MANLLTPLYMQPVQLAGSVNTSLGLWRVSSETEGKVLKRIRVYRLTRSIP
PtIP-65Hf     (1)   MTSLLTPPYMQPIQSAGGLFSSF---IVSGETEGKVLQRIRVYRFSRNIA 51                                               100
PtIP-65Hb     (47)  AVEFWLTGNSTPYVYGTPR-ADNSSYEFVDGERITRLDFRTHLFGVV-TI
PtIP-65Hc     (49)  AIEFWLTGDSTPRVYGTVR-SENSSFDFSEGERITGLRFRNALFGIG-QN
PtIP-65Hd     (49)  AIEFWLTGDSTPRVYGTVR-SENSSYDFAEGERITRLRFRTSRFGFGVQT
PtIP-65He     (51)  AIEVWLTGDSNPHVCGTPGRAESSTFEFSEGERITTLVLQDAQNIP----
PtIP-65Hf     (48)  AIEVWLTGDSNPHLCGTPGRAESSTFEFSEGERITTLELQEDPQLPY---

101                                              150
PtIP-65Hb     (95)  QWDNIARVRFSTSRGRIFEFGSSREPSGQWFTANVGSGVCVGMSGV-EAN
PtIP-65Hc     (97)  QWNHVARVWFSTSRGRTFEYGSTREPTGQWFEVNVGSGVCVGVAGN-VML
PtIP-65Hd     (98)  QWDHVARVWFSTSRGRTFEYGSTREPSGQWFEANVGSGVCVGVAGN-VML
PtIP-65He     (97)  --THVGRIRFQTSLLRTFEYGMSVQPTGKVTTVNVGSGVCVGVRASHSST
PtIP-65Hf     (95)  --TVVGRIRFQTSRLRTFEYGMSVQPSGRVITVNVGSGVCVGVRAG-TAL
```

Fig. 6b

```
                151                                              200
PtIP-65Hb (144) GALTRLGFMFLRSIQSVGFSSVEYPTLSTSTILTTPILEQLPDTFKSNDD
PtIP-65Hc (146) NSLNMLGFVFLRSIQSVGFSSVEYPMFSTS-ITRTSILEQLPDTFKSNDD
PtIP-65Hd (147) DSLNMLGFVFLRSIQRVGFTSVEYPTISSS-IARTFILSHLPDTFKSNDD
PtIP-65He (145) YGISVFGFMFLRPIQSVRLHGLVYPTISSTSTITTTILQELPATIKNDND
PtIP-65Hf (142) SVISILGFMFLRPIRSVRLHGLVYPTISSISTITTTILQELPATLKNDDD 201                                              250
PtIP-65Hb (194) DEPLHVVLAGSRQLETTSTW---TSPAVGLLSHLTGNDITVNVSLGINTP
PtIP-65Hc (195) DEPLQMVLAGSRQFKTSSTWR-VSSPTVGLLSHLTGNNILVDVTLGINTP
PtIP-65Hd (196) DEPLQMVLAGSRQFKTTSTWR-AQSPAVGLLSHLTANNITLDLTLGINTP
PtIP-65He (195) HEPLHWVLAGSRQCITSSTWRTQPADREGLVSHLVGRAISINIDLGIDTP
PtIP-65Hf (192) HEPLHWVLAGSRQCFTSSTWRTQLAYRAGLVSHLVGSAISINMDLGIDAP 251                                              300
PtIP-65Hb (241) TVVPSG-PEGASTTFHWQTVRTFPSSN-AMEGSIANLTVTTNEYSVWCHI
PtIP-65Hc (244) TVVPTG-LAGASTTFQWETVRAFPSTN-AIQGSISNLTVSTDEYSVWCHI
PtIP-65Hd (245) TVVPTG-TAGASTAFQWQTVRTFPSINAEIQGTIANLTVSTAEYSVWCHI
PtIP-65He (245) KIVATGGTAGASTNFGWETARTFPSTN-AVEGSIADLTVRTNEYSVWGHV
PtIP-65Hf (242) KIVATGGTAGASTNFGWETARTFPSTN-AIQGSIADLIVSTNAYSVWGHV
```

Fig. 6c

```
              301                                              350
PtIP-65Hb (289) SDTIAPAQLLP-KHVALVGEGRITALPCSARIQVLTSSAYDLPFATFSFP
PtIP-65Hc (292) SDTVAPAQSLP-KHAAWVGEGRITALPCSANIQVFTSGGNNFPFGTFSFP
PtIP-65Hd (294) SDTVAPAQSIP-KHSAWVGEGRITALPCSANIQVITSGGNNLPFASFSFP
PtIP-65He (294) SDTLAPAQSLISRRAVLIGEGSIDNLQCSARIQVFTDADGGLPFATFTFP
PtIP-65Hf (291) SDTLAPAQSLISRRAALIGEGRIDNLQCSARIQVFTN-DSALSLATFTFP 351       368
PtIP-65Hb (338) VQSLYNGRAHSQVQIIDP
PtIP-65Hc (341) VRLLYDGGAHSNVQVL--
PtIP-65Hd (343) VRLFYDGGAHSTVQVL--
PtIP-65He (344) VGVLYSARAHSDVQVLS-
PtIP-65Hf (340) VGVLYSARAHSDVQVLS-
```

Fig. 7

|  |  | 1 | 50 |
|---|---|---|---|
| PtIP-65Fa | (1) | MAFQTPVTLIGASSGGQQFSAYGGTDGKLLEKIGVWAGDSRIKAIKVWLT | |
| PtIP-65Fb | (1) | MAFQTPVTLIGGSSGGQQFSAYGGTDGKLLEKIGVWAGDSRIKAIKVWLT | |

|  |  | 51 | 100 |
|---|---|---|---|
| PtIP-65Fa | (51) | DEAAQLFGDPHDPPGEGPLHYKEFAFQPAELITRLSLWGNGAGTRAGWIY | |
| PtIP-65Fb | (51) | DEAAQLFGDPHDPPGEGPLLYKEFTFQPAELITRLSLWGNGAGTRAGWIY | |

|  |  | 101 | 150 |
|---|---|---|---|
| PtIP-65Fa | (101) | FETNQSRSFDFGMYSWGKKKEYPVDVASGICAGVMGTAASDINNIGFVFL | |
| PtIP-65Fb | (101) | FETNRSRSFDFGMYSWGKKKEYPVDVASGICAGVMGTAASDINNIGFVFL | |

|  |  | 151 | 200 |
|---|---|---|---|
| PtIP-65Fa | (151) | KPIQSSKLINVQYPSLSFDTQGISPQTLKEFNHTNTSNNPTNWEFKGSSA | |
| PtIP-65Fb | (151) | KPIQSSKLINVQYPSLSFDTQGISPQTLKEFNHTNTSNNPTSWEFKGSSA | |

|  |  | 201 | 250 |
|---|---|---|---|
| PtIP-65Fa | (201) | VTVSSSWSLTTGLAVHASVTVEAGIPAVADVSGEFGWEVSASTTSQSSTT | |
| PtIP-65Fb | (201) | VTVSSSWSLTTGLAVHASVTVEAGIPAVADVSGEFGWEVSASTTSESSTT | |

|  |  | 251 | 300 |
|---|---|---|---|
| PtIP-65Fa | (251) | ETDTLSWGVSGTLSAGESIHLKALTRKGLISVPYIGSIQVTLKSGDVFQY | |
| PtIP-65Fb | (251) | ETDTLSWGVSGTLSAGESIHLKALTRKGLISVPYTGSIQVTLKSGDIFQY | |

|  |  | 301 | 317 |
|---|---|---|---|
| PtIP-65Fa | (301) | PLKGQYSGISYSGVTVT | |
| PtIP-65Fb | (301) | PLKGQFSGVSYSGVTVT | |

Fig. 8a

```
              1                                                        50
PtIP-65Hg  (1) MQYGLANTEASPLIEKFQALMEGGIDESILATKLVGAEGDASHLPPPGET
PtIP-65Hh  (1) --------------------MAQLQQHVVNSKHAYGKHAPASKVCEIARA 51                                                      100
PtIP-65Hg (51) PSEDGAGKDPPNESLETEDVEEHADDSKARSASVTAPLRFIGGPGGSQRS
PtIP-65Hh (31) PVHAYKGSN---------------QG------DVTAPLTFIGGDGGKQVS 101                                                     150
PtIP-65Hg (101) VRGWTNGRVITRMRVYRARGTIKAYQIWLT---DSAPQTHGVPGNSDFAE
PtIP-65Hh  (60) KRAWESGKLITRLRVYSGYSCIKAMKVWFTGDEYSEGTCLGEPDGTDYKE 151                                                     200
PtIP-65Hg (148) YTFRTGERLTRLTLWGNGMGTRAGWIEFETSLGGRFSYGMSHWSLRTPYP
PtIP-65Hh (110) YTFSEGERITRMSLWGNGNGTRAGWISLSTNKGGVFSYGMHGWPLCTEYP 201                                                     250
PtIP-65Hg (198) VDVGSGILVGYIFNAGEDVDAHGFWFLN-HIEQAELTNVRYPTLGFDTAG
PtIP-65Hh (160) VNVGSGILAGAIYNAGCDIDAHGYYFLSSSVTSSKLENVKYPTLKFDTSG
```

Fig. 8b

```
              251                                                300
PtIP-65Hg (247) IVPTALDTFRFRNNSSTPRDWDFSRNMSRSTERTWSITVDLTVHASITVS
PtIP-65Hh (210) ITPVSLDTYKQTNTSSSPRNWSFGGKRTVKSTTKWGLKIANTFNVELSVE 301                                                350
PtIP-65Hg (297) AGFPGIANVSGQYGWEIGVTGHFETTETSEHDLSWSVGGRVQPGDVVDLT
PtIP-65Hh (260) AGVPQVSKSGAKFGWTISVASDHEESEERTQELVWSTGGTLQPGETVDLV 351                                                400
PtIP-65Hg (347) ALTRTGTLN-IPYEGTMVVRMRNGASFSYAVRGTYRGLSYTGTKINDNST
PtIP-65Hh (310) ALTRQGNLNDLRFEGTMVVTLKNGASFRFPLSGPYKGICYTGVEIKDHEE 401       414
PtIP-65Hg (396) --------------
PtIP-65Hh (360) TKTMAMKSYASLCL
```

Fig. 10a

```
                     1                                                                70
PtIP-50Aa    (1)  ------------------------------------------MAAGDYSVLYQDVNQIS--IR
PtIP-50Bd    (1)  ------------------------------------------MAGIDYSVLYQDVNQIS--IR
PtIP-50Bb    (1)  ------------------------------------------MADIDYSVLYNDVNQIS--IR
PtIP-50Ba    (1)  ------------------------------------------MADLDYSKLYQDLNQIS--VR
PtIP-50Bc    (1)  ------------------------------------------MADVDYSKLYHDLNQIS--IR
PtIP-50Fb    (1)  -----------------------------------------MGGAVPDYSHLYRELNQVSEGMK
PtIP-50Fs    (1)  -----------------------------------------MGGAVPDYSHMYRELNQVSERMR
PtIP-50Fo    (1)  --RERGVLNGMLTSDHPFWGDWGVCSEA-HRSICLVCPDQSLHEIA-MGGAVPDYSHMYRELNQVSERMR
PtIP-50Fk    (1)  EIETEKVLIVCERVAYLFLGGWGACSEAPYRAIGILSADQNPHEIFTMGGAVPDYSHLYRELNQVSERIR
PtIP-50Fe    (1)  ------------------------------------------MERAVPDYSHMYRELNQVSERIR
PtIP-50Fl    (1)  ----------------------------------------------------------------------
PtIP-50Fn    (1)  ------------------------------------------MERAIPDYSHLYRELNQVSERIR
PtIP-50Ft    (1)  -----------------------------------------MAAAAREYSELYKDLNQISERIR
PtIP-50Fd    (1)  ---------------------------------------MAAARSAGANEAWREVYHDLNQVSDRIR
PtIP-50Fm    (1)  ------------------------------MQGRLASMAGSAGAADAWREVYRDLNQVSDRIR
PtIP-50Fr    (1)  ----------------------------------------MAARSAGAADGWREVYRGLNQVSDRIR
PtIP-50Fg    (1)  -----------------------------------------MANDTSSGIVDWRELYRDMNQAEDRIR
PtIP-50Fh    (1)  -----------------------------------------MASITSGAGADWRELYSEMNQVSERLR
PtIP-50Fp    (1)  ------------------------------------------MASLPDYYEIYKNVNQVSR--P
PtIP-50Ga    (1)  -------------MHPRAHDGIS-IPLQQGDDHDAEERQISQMRPRFKAN-VVEDYEEIYRGSNSIAREVG
PtIP-50Gb    (1)  -------------MHPTGHDGISNIPLEQCHDDYAEE---RQMKPRFETNGLELDYEKIYAGSNSIAREVG
PtIP-50Gc    (1)  -------------MHPTGHDGIS-IPLEQGDDDYAEES-RQMIRPRFKANGLELDYERIYAGSNSIAREVG
PtIP-50Gd    (1)  -------------MQQSVHIAARMPGDGEKGRFSSDEEHQMMMRPRLTSN-VPEDYEAIYAGSNSIREVG
PtIP-50Fa    (1)  ------------------------------------------MEYSALYGDVNQIS--LR
PtIP-50Ff    (1)  ------------------------------------------MEYSSLYGDVNQIS--LR
PtIP-50Fq    (1)  ----------------------------------------------------VNQVS--LR
PtIP-50Fi    (1)  ------------------------------------------MEYSDLYHDVNMES--LP
PtIP-50Fj    (1)  ------------------------------------------MEYSDLYADVNQVS--LR
```

Fig. 10b

|  |  | 71 | | 140 |
|---|---|---|---|---|
| PtIP-50Aa | (20) | LEKMDFSEVMAVHRMTVRMDDLDVSSGTG--LLSGAEKVKRLIVFADVVELP----------SKQLRLPG |
| PtIP-50Bd | (20) | LEKMDFSEVMAVHRMTVRMDDLDVSSGTG--LLAGAEKVKRLIVFADVVELP----------SKRVRLPG |
| PtIP-50Bb | (20) | LEKMDFSEVMAVHRMTVRMDDLDVSSGTG--VLEGAQNVKRLIVFADVVELP----------SKQVRLPG |
| PtIP-50Ba | (20) | LEKTEFSEVMVHRMTVRMDDLDVSSGSG--LLSGAEKVKRLIVFADVVELP----------SKQVRLAG |
| PtIP-50Bc | (20) | LGNVEFSEVMVHRMTVELDDLDVSGSG--LLSGAEKVKRLIVFADVVELP----------SKQVRLAG |
| PtIP-50Fb | (24) | LDQMEFSEVMVIHRMTIRLHDLNIAHRE------GAEQVKRLIVFADVVELSGTS--------LTTLPG |
| PtIP-50Fs | (24) | LDKIEFSEVMVIHRMTIRLPDLDIALQE------GAQQVKRLIVFADVVELPETSTSASA-EPVTLRLPG |
| PtIP-50Fo | (67) | LDKMEFSEVMVIHRMTIRLPDLDIALQE------GAQQVKRLIVFADVVELPEMSTSVTVSETVTLRLPG |
| PtIP-50Fk | (71) | LDQMEFSEVMVIHRMTIRLPDLNIAHLE------GAGQVKRLVIFADVVELGGHL--------VTTQLPG |
| PtIP-50Fe | (24) | MDQMEFSEVMVIHRMTIRLPDLSIAHLD------GADKVKRLIVFADVVELGSVQ--------QTSSLPG |
| PtIP-50Fl | (1)  | ---------MVIHRMTKLPDLDIAHLD------GADKVKCLIVFADVVELGSAG--------QTSNLPG |
| PtIP-50Fn | (24) | MDQMEFSEVMVIHRMTIKFPDLGIAHLE------GADKVKCLIVFADVVELGSVR--------QTSSLPG |
| PtIP-50Ft | (24) | LDQMEFSEVMVIHRMTIRLEELDLGHLE------GAERVKRLIVFADVVEVEEGGN--FIETGPLARLPG |
| PtIP-50Fd | (29) | LDQLEFSEVMVVHRMEIRMSELDLGHLE------GAEKVERLIVFADMVECDVPPHASSSDGDLVIRLPG |
| PtIP-50Fm | (34) | LDQLEFSEVMVHRMEIRMSELDLGHLE------GAEKVERLIVFADVVELDVVPHESSSDGDVVYRLPG |
| PtIP-50Fr | (28) | FDQLEFSEVMVIHRMEIRMSELDLGHLA------GAEKVERLHVFADVVECDVPPHENSSDPDLVIRLPG |
| PtIP-50Fg | (28) | FNQLEFSEVMVIYRMHIRMSELDMGHLE------GSEKVKRLIVFADVVEYDAN----G-----IARLPG |
| PtIP-50Fh | (28) | LDQLEFSEVMIIHRMEIKLSELDLGHLE------GADKVKHLIVFADVVELDNAADPSTP---VDVRLPG |
| PtIP-50Fp | (21) | VASRQASEVTSIHRMYFKINLLEVALLT------KADEVKELVYFADVVEMEG----------GKVELPA |
| PtIP-50Ga | (57) | VSKVNCGEVMAIHRMFRLDTLSQELLR------QPERVQRLIVVADVVEIEGSN--------DTLSLPG |
| PtIP-50Gb | (56) | LDKVNCGEVMAIHQMFRLDTLSQELLR------RPELVKRLIVVADVVEIEGSN--------ATLSLPG |
| PtIP-50Gc | (57) | INKVICGEVMAIHRMFRLDTLSQELLR------QPELVKRLVVVADVVEIEGAN--------ATLSLPG |
| PtIP-50Gd | (58) | VNKVRCGELMAIHQMFRLDTLSQELLQ------QPQLVKRLIVVADVVEIEGSR--------GTLVLPG |
| PtIP-50Fa | (17) | FEKTEFSEVVVHRMEVLAELNVILGDNNILLQGSDRVKRLIVLADVVELPP------I-FSTSMSLPG |
| PtIP-50Ff | (17) | FQNMEFSEVMVVHRMEVREELDMTG------LEGIEKVKRLYVLADVVELPSTAT---Q-VFQYLRLPA |
| PtIP-50Fq | (8)  | FQNMEFSEVMVHRMEVREELDMTG------VEGIEKVKRLYVLADVVELPPKAT---S-VFEYVRLPA |
| PtIP-50Fi | (17) | LHRTELSEVMVVHRMEVKRDLNET--------AVSDKVKRLIVVADVVEV----------TLDTVSLPC |
| PtIP-50Fj | (17) | FQQTEFSEVMVHRMYVELLDIDMTEPHLQMLAGSEKVRRLIVVADVVELP--------A-TATNMRLPA |

Fig. 10c

```
                 141                                                          210
PtIP-50Aa  (78)  TDLIVILCRIFVIN----------------GRHSTELFLPSMMSMVAPG----------------TG
PtIP-50Bd  (78)  TDMIIILCRIFVVN----------------GRHSTELFLPSMNMVAAG-----------------TG
PtIP-50Bb  (78)  SDMIVILCRIFVRN----------------GRHNTELFLPSMMSMVAAG----------------NG
PtIP-50Ba  (78)  TDMIVVFCRIFVPE----------------GRHYAELFLPSMMSMVGADG---------------EG
PtIP-50Bc  (78)  TDMIVVFCRIFVIN----------------GHHGTELFLPSTSMSMVAAG---------------EG
PtIP-50Fb  (80)  TMMVVILCRVLSVRSF--------------QSQHGLDFPHMRLHAV-PGD-NQMLRIHRRNPDSAQYD
PtIP-50Fs  (87)  TVMVVILCRVLLFQGS--------------YSAYDLDFPHMRLHAV-PGE-AQILRIHRRNPDSAQYD
PtIP-50Fo (131)  TVIVVILCRVLFYQG---------------FARYDLDFPHMRLHAVQPSG-AGVLRMHRLNPDSVQYD
PtIP-50Fk (127)  TVMVVILCRVLSLRSP--------------TARYGLNFPHMRLHAVFQSA-SRILHMHRLIPDSAQYD
PtIP-50Fe  (80)  SIMVVIMCRVLTLHVDPI------------ATAYQCDFPHMRLHAF--FG-SNGVRIDRRN-SDSVHD
PtIP-50Fl  (48)  SIMVVIMCRVLTLHADWS------------RTSYRFVFPHMRLHAI--FD-LQQARIHRRN-SDSVHD
PtIP-50Fn  (80)  SIMVVIMCRVLTLHLDSA------------AQAYRIDLPHMRLHAI--ND-AQRLRIHRRN-SDSLHD
PtIP-50Ft  (86)  SIMVVILCRVLSVRVLMFDNG---------NNAMRLQLPHMKLRVVEITT-QPTTKLQIHR-ADAEDY
PtIP-50Fd  (93)  SLSVIFICRVWHINVGVVQLTS--------TVQMSRTLIVQLPHMRWHVN-----ATTGSMHRLHPQTSQEG
PtIP-50Fm  (98)  SKSVTFVCRVWHINYALVQISS--------FARISRSVVLERHMRWHFN-----AITGRMHLLDPQTLQDG
PtIP-50Fr  (92)  SVSVTFMCRVWHVNYGIVQRTS--------TVRVARTVVVQLPHMRLHFN-----ATTGSMHRLHPQTSQDG
PtIP-50Fg  (83)  SISVVFLCREWHVSYHLVARMDRNPPRYQLDLAQGVIISLPHMAWRLD-----VRRQSMHRLDPETLQEF
PtIP-50Fh  (89)  SISVVFLCRVWHVSRRLTVGVNSPQYWLPTFDGRPVRLQLPHVKWHMN-----TLTRSMHRIDPETLQDL
PtIP-50Fp  (75)  SRIVTIVCRILSLKR---------------EDVELGFKFLGPVECEEG---WQVGLNSEMAYIRRTS
PtIP-50Ga (113)  SSLVLVLCRILILK----------------SKDVVLDFTSWDLTVATTT------------------
PtIP-50Gb (112)  SSLVLIFCRILILK----------------SRNLVLDFDNWNLRAASTT------------------
PtIP-50Gc (113)  SSLVLIFCRILILK----------------SRDVVLDFSNWDLPVATTT------------------
PtIP-50Gd (114)  SSLVLIFCRILVLK----------------SKDVVLDFGSWDLSVATTSS-----------------
PtIP-50Fa  (80)  TVSVVILCRILYLPYLEDASSAS--------G---WAVHAALLRLRVVEMHAGFAQVFTIPANDSSAAAP
PtIP-50Ff  (77)  SISAIILCRVLYIPEVDQRP----------HMAQCSLDFPFMRLHVVGSAHE--NGGGVMQAFSSDATP
PtIP-50Fq  (68)  TISAIILCRVLYIPEVQRLSGAG-------FRGQCSLDFPFMRLHVVGAAHE--SGGGVMQAFSSDATA
PtIP-50Fi  (70)  KVSVVILCRVLHVE--QSSVLF--------SSLLPNMFVRVVLSNN---RMQVYPMATDG--SA
PtIP-50Fj  (79)  TASVVILCRVLYVQDVNSPYLA--------CGLHFPLMPLRVVEDTQQG-RVHVFPVVGGESASV
```

Fig. 10d

```
                211                                                                 280
PtIP-50Aa (114) SIRGVILSPTTVLTTSS---------------------------------------------------------
PtIP-50Bd (114) SIRGAYLS-TTAFSLSS---------------------------------------------------------
PtIP-50Bb (114) TIRGVNLS-TTMSSSSS---------------------------------------------------------
PtIP-50Ba (115) SIRGVILS-PTVLTTLS---------------------------------------------------------
PtIP-50Bc (114) SIRGVILS-PTTLTPLS---------------------------------------------------------
PtIP-50Fb (132) DYPVVCVHADVLEFPVTG------------------GRDIFHLGPLANPCMVITFPP--------QS
PtIP-50Fs (139) DYPVVCVHADVLEFPVTG------------------GRDIFHLGPLANPCMVVTHPQ--------LS
PtIP-50Fo (183) DYPVVCVLADVVEFTRQR------------------PSRLFRIGPLAYPSMIFTDERP----PASSI
PtIP-50Fk (180) AYPVVCVHADALEFSGTS------------------TGGIFHIGPLRYPSMIVTSES--------HS
PtIP-50Fe (132) DYPVTVSANVIEFSGTR-------------------AETLFAIAPLRDPSMIISS-------DLISN
PtIP-50Fl (100) DYPVTISANVIEFSGTRS------------------SSVLFGIGVFLDPSMVLS--------SDRHS
PtIP-50Fn (132) DYPVTISANVIEFSGTRS------------------LRDIFGIGPLQDPSMIITNT------ETQPP
PtIP-50Ft (143) QYPALCIHADVIQASIRLSSS-----------SNRPPMDLRFFNFRPNRGSDNVVFSSE-------SRS
PtIP-50Fd (152) PDTSFCVYAEVVQVAYY---------PDVTFSEFDGSPT-LRFLRLEFESDQLRVTTQT----EGPIWAI
PtIP-50Fm (157) MDLCFCVHAEVVQIAYY---------PDVTFPESNDSPSFLRFLRLEIVPDQLRVTTQT----DGPVWAL
PtIP-50Fr (151) SDTCFCVYAEVVQIAYY---------PDVTYPESNDSPVGLRFLRLEFGSDQLRVTRQS----EGPVWAL
PtIP-50Fg (148) LEPSFCVYADDISVAYYSLNGAS-WDPALQFPDTAELAKCALLIYSNSNPTPNHVLLTSNR-FNGTRWAF
PtIP-50Fh (154) SGPLLCVYADLLRTSLHPPVGHSNWDAALAFPSMTVLREVEVLPCFDHSTPRQGLLTLT----SNAAPQW
PtIP-50Fp (124) PQVRLSIYAQEVVHNSTG--------------------------AILRVTHPVTVRQRVSPHRP
PtIP-50Ga (146) PLHRCSIHAQRVVVASG---------------------------SLSASLLIQVKHKFEWSDGTHLDQ
PtIP-50Gb (145) PLHRCSIRAQRVVIASGF--------------------------SLYSSLLIQVKHKFEWSDGTHLDQ
PtIP-50Gc (146) PLHRCSIRAQRVVVASG---------------------------SLSASLLIQVKHKFEWSDGTHLDQ
PtIP-50Gd (148) PLVRCSIRAQQVVISSG---------------------------SLSASLLIQAKHRLRWSDGSHLDQ
PtIP-50Fa (139) ADIGLYIHADRIIYRDD-----------------PGRSIPVIEVRVGGDSRFSPFLP---GSP--EIR
PtIP-50Ff (134) SNIGIYFHADRFIYRQAT----------------SSASNFVLPLDVRVSFGSSTFSAPTLRPDWQNLN
PtIP-50Fq (128) GNIGVYLHADRFIYREAA----------------SPASDFVWPLDVRVSFGSSTFSN-TAVPDWQNLN
PtIP-50Fi (120) DDVALYIHADRVIRRQG-----------------AWTLVRVMHMSITGPE-----STFSVPHLPDPAL
PtIP-50Fj (135) DKIGLYIHADRVVYRQD-----------------TSTANPLQPLQLRVIGNGSTFSTEVRPDWPKTLE
```

Fig. 10e

```
                     281                                                          350
PtIP-50Aa   (131)  -DALQFKLQSGSMTSVMRLKDVSVAATLTCNVQAAS----------ASMPLTVKTTGTSPGNICVLGMS
PtIP-50Bd   (130)  -NALQFKLQSGSMTSAIQLKDVDLAATLTCDVQAAS----------ASMPIVVKTTGTSPGNILVLGMS
PtIP-50Bb   (130)  -NALQFNLRSGSMTSVRLKDVDVAAALTCDVQAAS----------ASMPLTVMTTGTSPGNIWVLGMT
PtIP-50Ba   (131)  -NALQFRLECGSMTSVMRLNDVSAGATLTCNVQAAS----------ACVPLKVKTTGTSPGNICVLGLS
PtIP-50Bc   (130)  -HALQFKLESGSMTSVMRLNDVSVAATLACNVQAAS----------ASMPLKVKTTGTSPGNICVLGMS
PtIP-50Fb   (173)  LEEAPVSSFTGSVRLWTAAASSPH----RIDPNNLT-------FTPGFMVQQGGSFNLPFNTQSE-----
PtIP-50Fs   (180)  LVEAPVSSFTGSVRLWSAATSSPH----SIDPNNLT-------FTPSFSVQGGGSFNLSFATRSE-----
PtIP-50Fo   (228)  VEPRPVSSFYCTIEFRWSSSNN-------IGPNSVG-------IGCVFRLSGGS--TFSTGSPRE-----
PtIP-50Fk   (221)  AVDAQISSFSCNVSLRSASASSPL----KINPDNVS-------FQSMFNLVTGG--GFGFAVRPE-----
PtIP-50Fe   (174)  TVERPASGFFCNVVPNWG-QPSPI----TVDPLRIR-------FQTGATMVGGGSLT--FPLGPE-----
PtIP-50Fl   (142)  IVERPSSHTLCNVNPVE--QSSPI----MVDPDTIR-------FQSIFNWVGSNIMSPQVARAPE-----
PtIP-50Fn   (176)  VVERPSINSLCTVGLVQGQSSSPV----TVDPDRIS-------RHFWFQSVGGGALG--TLRAAE-----
PtIP-50Ft   (194)  LIDEPVEIFYVYSHIPRFIHALPIPEAATVDPASRS-------NDWYYVSLRRVNSTLSSSVAAEGELEP
PtIP-50Fd   (208)  RASLDTTMTPDNDGLLNEISAQPAGTIFKLNILPDN-------LIVSLFGSLRPNSSTSLTR-VPDNLLP
PtIP-50Fm   (214)  RGALEYFMAPDNDGLLNEVSSQPAGTSFVLNILPDN-------LDVQLFANLRPNSGTTLTR-DPNTIVP
PtIP-50Fr   (208)  RGSLNYSMSPDNDGLMNEVSSQPAGTSFILNILPDN-------LNLQLMASLRRNSNSTLTR-DPDNIVP
PtIP-50Fg   (216)  RFEFS-MYYIDNEDVAKDIALQPPGTRVIFKREGLH-------LVVLAMDSANRIISFDPERGDLDAYMP
PtIP-50Fh   (220)  VNQIRAAFIFTDQDAMTEILSLPADASVILNKNRPS-------IILTAGQSG-----G--YT-DRNVSAP
PtIP-50Fp   (162)  SQYTPGTMKWQINISSAHADLSTAQRSHELRTQRFWS-------------------EPERTWLINPQEWS
PtIP-50Ga   (187)  YFGRPFSFIASEINSSATATTRTNSAMRSISTWPG----------TAPVSNFIRVNSEKFNVLVNAVPW
PtIP-50Gb   (187)  YFGRPFYFTAIGINSSATITTTATSAMRSINTWPG----------TAPVSNFIRVNSEKFNVLVNAVPW
PtIP-50Gc   (187)  YFRRPISFTASRINSSAAITTRTTSATRSINTWPG----------TAPVSNFIQVNSEKFNVLVNAVPW
PtIP-50Gd   (189)  YFGRPFSFASSKINSFATTTTQTSYAKQSISTWPG----------VPPTSNLIVVNSETFNVRVNAVPW
PtIP-50Fa   (185)  LSSVQYVREFS-KGQPVAPEDSELQRSDETELIAP----------SGSEQQLRAAFGASVGMNLLFHFSS
PtIP-50Ff   (186)  VSNIQYGPQHLSRGPPLTSSDSDLQRSDETELLAQQDVWSPLLHVAFSPNAPPGNIPGTQGIFRPSSACS
PtIP-50Fq   (179)  VSSIRYDSQRLSKGPPLTSSDSDLQRSDETELLAQQDIWSPILHVSFNPNAPPGNVPGTQGLFRPSSACS
PtIP-50Fi   (166)  FNRVMVNVQMD-AGPSIPASESDLQRSDETELVS-------RVSNGVTVSASIAGSAWTMPADNPSATFT
PtIP-50Fj   (186)  VSSILMWLTLS-KGQPIPAAESDLQRHDEVELLSPPSPD--RLSVVFAYLAPGNLFSIAVDVEYIGAGFC
```

Fig. 10f

```
              351                                                                     420
PtIP-50Aa (189) TAVVVPES---AVAVITDANILLGMQVTVLIAELVKIANN-SDVLIAAVTRHVEWLNHLLVQ--------
PtIP-50Bd (188) TAVVIPES---AVAVITDANILLGMQVTVLIAELVKTANN-SDVVIAAVTRHVEWLNHLLVQ--------
PtIP-50Bb (188) TAVVIPES---AVAVITDANILLGMQVTVLIAELVKTANN-SDVIIAAITRHVEWLNHLLVQ--------
PtIP-50Ba (189) TAAVVPES---VVAVITDANILLGMQVTVLIAELVKIANN-SDGVIAAVTRHVEWLNHLLVQ--------
PtIP-50Bc (188) TDAVVPEN---VKAVMVDVILMCMKLTVLIAELVKIANN-SDAVIAAVTRHVEWLNYLLVQ--------
PtIP-50Fb (227) DFWLLRRNLP--DALLKDSSILLCMQTSMLIAEVEFSHP-SSDVRAAVTLHAEWLNNLLLQASAKS---
PtIP-50Fs (234) DFWLLQRNLP--DALLKDSSILLCMQTSMLIAEVEFSHP-SSDVRAAVTLHAKWINTLLLQASAKS---
PtIP-50Fo (277) DFWLFRRDLP--DALFKDSSILPCMQTSMVAELVEFCHP-SPDVRAAIRSHAKWLNTLLLQASVAS---
PtIP-50Fk (273) EFWLLRRDLP--DALLNDSSILLCMQTSMLVAELVEFSHP-SSDLHAAILHAEWLNTLLLQASAAS---
PtIP-50Fe (225) GFSILQRNLP--DLLLIDPNILLCMQTSMLVAELVEFSHP-SSDHAAVTDHVAWLNTHLLQASAKA---
PtIP-50Fl (194) GFSLFRRDLP--DLLLIDPNILLCMQTSMLIAELVEFSHP-SSDHAAVTEHLIWLNTHLLQASTKA---
PtIP-50Fn (228) GFSLFQRDLP--DVLLIDPNILLCMQTSMLVAELVEFSHP-SSDIHSAVTEHVVWLNTHLLQASTKA---
PtIP-50Ft (257) AFSLLKPKIP--VVVLTDPNILLAMQTSLLIAELVEVANP-SAETADAVAKEVEWLNKILLQATKVEG--
PtIP-50Fd (270) AFSIFREKAV---ELLTDPDVLSAMQTSMLIGELVEVGQP-PEATTEVVRKHIEWLNNLLLKVIEAK---
PtIP-50Fm (276) AFSVYKEKEG---ELLSDPNILPAMQTSMLIGELVEVGQP-PSVTTEVVRKHVEWLNNLLLQVIEAK---
PtIP-50Fr (270) AFSVYREKLAV--ELLTDPNTLPPMQTSMLIGELVEVGQP-PEATTEVVRKHIEWLNNLLLKVIEAK---
PtIP-50Fg (278) AFSLLRQDAKFPIELLTDPNILSAMQTSMLIGELVEVGNP-STAVTEVVHKVKWLSKLLHQVIEEK---
PtIP-50Fh (275) AFSVLREGAETPIDSLTDPNFLPAMQTSMLIAELVEVGRP-SAAIIEVMHKVEWLNNLLLQVIEAK---
PtIP-50Fp (213) PETFFLPPGLLPLAILGDSNIMLGMQSTLLIAELVLSYQTHAQAIVSAAHRELQWLTTNLVQVLDDDS--
PtIP-50Ga (246) KGVVDCQASLPSLDDLLHEDVISGIQSTLLIVETILNFQTDNPAIIILAQQHAEWIVDSLLQVVHLP---
PtIP-50Gb (246) KGVIDCQAALPSLDDLLHEDVISGIQSTLLIVETILNFQTDNPAIISLARQHAEWILDSLLQVVPLP---
PtIP-50Gc (246) KGVVDCQAALPSLDDLLHEDVISGIQSTLLIVETILNFQTDNPDIVLARQHAEWIVDSLLQVVPLP---
PtIP-50Gd (248) KGVVDCQTALPSSDDLLHEDVISGIQSTLLIVETILNFQTSNPSIVLAQQHAQWIVDSLLQAVHLP---
PtIP-50Fa (244) SFDILSLDPV-PAALLTDPNITGMQMNMLIAELVLTAAHNEPQLIKVVTREVEWLNKMF----------
PtIP-50Ff (256) FFHVPPPD-V-PANVLTDDSIILGMQMNMLIAELVLAAAN-SPQVMNVVTKEVLWLNKII----------
PtIP-50Fq (249) FFHVPPPD-V-PANVLTDDSIILGMQMNMLIAELVLAAAN-SPQVMNVVTKEVLWLNKII----------
PtIP-50Fi (228) VFPNPPAQPV-ARGVLTDEYVIIGLQMNMLTAELVQAAAN-APLLIRAVTREVEWLNKII--------VE
PtIP-50Fj (253) YFRIPPADPV-PTEVLTDEYVIIGLQMNMLIAELVLAAAN-SPPVISVVTKEVEWLNKILPNDDILALLF
```

Fig. 10g

```
                  421                                                              490
PtIP-50Aa  (247) -AEAAAPSEDVVALLYRTQGFIKLRNEG-----LIVPRLQYRMYKDLIDRMVQVAQSYDQDIQLKLVE
PtIP-50Bd  (246) -AEAAAPSDDVVALLYRTQGFIKLQRED-----LVVPGLQYRMYKDLINRMVQVAQSYDQDIQLKLVE
PtIP-50Bb  (246) -AEAAAPNEDVITLLYRTQAFIKLKREG-----LIVPRLQYHMYKNLIDRMVQVAQNVDQDIRQLKLVE
PtIP-50Ba  (247) -AQAAAPSEDVVALLYRTQAFIKLRKEG-----LIVPRLQYHMYKDLIDRMVQVAQSYDQDIQMKLVE
PtIP-50Bc  (246) -ALVAAPSDDVVMLYRTQALIKLQKEG-----LIVPRLQYHKIKDLIDRMVQSYDHDIQLKLVE
PtIP-50Fb  (291) --QGTPHHDDYRALLFRAQYVVKG-IGRSR--GAVVPQLQYDMISNLINQMARAADSYDQSLKQLKLFIA
PtIP-50Fs  (298) --EGTPHHADYRALLFRAQYVVKG-VGKSR--GAVVPQLQYDMISNLVNQVARAADSYDQSLKQLQLFIT
PtIP-50Fo  (341) --EGTPHHSDYNALLFRAQYVIKG-VGKSR--GAVVPQLQYDMISNLVNQVARAADSYDQSLKQLQLFIA
PtIP-50Fk  (337) --QGTSHHDDYLALIFRAQYLIKG-VGRAR--GAVVPQLQYDMISNLINQMARAADTYDQSLKQFQLFVA
PtIP-50Fe  (289) --QGTSSHDDYLALIFRAQYLLKG-MGRAR--SLVVPQLQYDVYRNLISQMARVAESYDQSLKQLQLFVA
PtIP-50Fl  (258) --QGTSSYDDYLALIFRSQYLLKG-MGRAR--SLVVPQLQYDVYRNLINQMARVAESYDQSLKQLQLFLA
PtIP-50Fn  (292) --QGTSSHDDYLALIFRAQYLLKG-MGRAR--SLVVPQLQYDVYRNLINQMARVAESYDQSLKQLQLFIA
PtIP-50Ft  (322) --ILNSSHDEHLALLFRAQYLMMRPGRTR--NLVVPQLQYDVYSNLVNRMAQVAESYDQSLRQFKLFID
PtIP-50Fd  (333) --QG-QHVEDYVELSFRAQYVIKN-VGKIQ--RMVPQLQYSAYSNLINRMAQVAESYDQARQFKLFIQ
PtIP-50Fm  (339) --RG-EHVEDYVELSFRAQYVIKK-VGRIQ--RLVVPQLQYSAYSNLINRLAQVAESYDQARQFRLFIQ
PtIP-50Fr  (334) --QG-EPVEDYIELSFRAQYVIKK-VGRVQ--RLVVPQLQYSAYSNLINRLAQVAENYDQARQFRLFIQ
PtIP-50Fg  (344) --NG-KDVEDYIGLSFRAQYVIKK-VGRIR--GLVVPQLQYDVYSNLINRMAQVAESYDQARQFRLFIQ
PtIP-50Fh  (341) --KGKDDVEDYIQLSYRSQYILKN-VGRID--RFVVPQLQYDEYSPLINRMAQVAESYDQARQFRLFIQ
PtIP-50Fp  (281) --LENEIREQLLALIARELASKLPIDGSQ--NLIVPREYGQYRGLISSMAAVAEAYNSETAVNLFIQ
PtIP-50Ga  (313) --DSTFGVAEVKTLLARAQMMKLPTDG--SQHLQVPLLAYGEYQEDIDQLLRNAEAYDQEYRELTRFVQ
PtIP-50Gb  (313) --DSTLGVPEAKTLLARAQIIMKLPTDG--SQHRVPLLAYGEYQEDTRLLRNAEAYDQEYRELTRFVQ
PtIP-50Gc  (313) --NSTLGVPEVKTLLARAQMIKLPTDG--SQHRVPLLAYGEYQEDTRLLRNAEAYDQEYRALTRFVQ
PtIP-50Gd  (315) --NSTTGVPELKTLLARSMVVKLPTDG--SQHLKVPLVYGEFQEDIDQLLRNAEAYDQEYRQLTRFVQ
PtIP-50Fa  (303) -LQLASPNDDILALLFRVQAYQMAKQP----HPVVPRMRYSRYEGLINQMVQIAQSYDQDIQIKLFIA
PtIP-50Ff  (313) -LQVASPNDDILALLFRIQAFMKMAKEP----RVVPRLQYHMIGSLINRMVQAQNYDQETQIRLFIA
PtIP-50Fq  (306) -LQVASPNDDILALLFRIQAFMKMAKQPRFVPREVVPRLQYHMIGSLINRMVQAQNYDQETQIKLFIA
PtIP-50Fi  (288) ALQVVSGNEDLLALLFRTETYLMATES----RSVVPRLQYHMISDLINRMVQVAQAYDDETQIRLFIA
PtIP-50Fj  (321) RVQLSLPNDDILALLFRVQAFLKMAKQP----RSVVPRLQYHMISPLINRMVQAQVYDQETQIRLFIV
```

```
                    561                                                              630
PtIP-50Aa  (378)  AG-LIAYQNKQVANAVTAVLGAIASIGLAFATGG---ATAPGAVASAGAAVTAAGKAAEG-----LKKVV
PtIP-50Bd  (377)  AG-LIEYQNKQVANAVTAVLGAIASIGLAFATGG---ATAPGAVAAAGTAVTAAGKAAEG-----LKKVV
PtIP-50Bb  (377)  AG-LIEYQNRQVANALTAVLGAIASIGLAFATGG---ATAPGAVSAAGAAVTAAGKAAEG-----LKKVV
PtIP-50Ba  (378)  AG-LIVYQNKQVADAVTAVMEAIASIGLAFATGG---ATAPGAVASAGAAVSAAGKAGEG-----LKKVV
PtIP-50Bc  (377)  AG-LVEYQDKQVADAVTAVLEAVSIGLAVATGG---ASAPEAVSAGAAVSAAGKAAEG-----LKKVV
PtIP-50Fb  (423)  AG-LRRFFNRQVANAMFSVFRAIGAVALTVLTGG---AAAPLAISAAKGAVSIAGQAARG-----LERVL
PtIP-50Fs  (430)  AG-LRRFFNRQVANAMTAVFRAIGAVALTVLTGG---AAAPLAISTAKGAVSIAGQAARG-----LQRVL
PtIP-50Fo  (473)  AG-LRRFFNRQVANAISVFRAIAAVALTVVTGG---AAAPLAMSTAKGAVSAAGQAARG-----LERVL
PtIP-50Fk  (469)  AG-LRRFFRDRQVANALISVFRAIGAVALTVLTGG---AAAPLAISAAKGAVSIAGQAARG-----LERVL
PtIP-50Fe  (421)  AG-LRRFQNRQVANAMTAVFRAIGAIALTVVTAG---AAAPAMAAAKGAVTIAGQAARG-----LVRVL
PtIP-50Fl  (390)  AG-LRRFQNRQVARAITAVFRAIGAVALTVVTGG---AAAPAAMSAAKGAVSIAGQAARG-----LERVL
PtIP-50Fn  (424)  AG-LRRFQNRQVARAMTAVFRAIGAVALTVVTGG---AAAPAAMTAAKGAVSIAGQAARG-----LERVL
PtIP-50Ft  (455)  AG-LREFQNRQVANAMTAVIGAIAAIGLAFITGG---ATAPAAVGAAKTAVTAAGAAARA-----LERVV
PtIP-50Fd  (464)  AG-VRKFQNEQVARGLTAVLGAIGAVGLTFLTGG---AAAPLAISTARRAVSVAGAVAQG-----LQTVL
PtIP-50Fm  (470)  AG-IREFQNRQVARGLTAVLGAIAAVGLTLLTGG---AAAPLAMSAARSAVSLAGAVAQG-----LQRVL
PtIP-50Fr  (465)  AAGIRRFQNAQVARGLTAVLGAIAAVGLTLLTGG---AAAPLAVSAARRVVTVAGAVAQG-----LQRVI
PtIP-50Fg  (475)  AG-LRRFQNRQAARALFAVLGAIAAVGLAFLTGG---ATAPAALCAARTAVTVAGSVVSG-----LQRVL
PtIP-50Fh  (476)  AG-LRRFQNERVARAVTGVLGAIAAVALAFVTGG---ATAGAAICAAKTAVTLAGAAARG-----LQQVL
PtIP-50Fp  (414)  AG-LKKYRDAQAARAFFAVMKGVLEIGAAIFTGG---ATMGLAVQGGINAVKAVSSLAGK-----LDMVL
PtIP-50Ga  (446)  QG-LEDYRRQLTRAIFGILGALLQLCASLKFGG-ADIAGGIATTVPAAIDMIHAVEDASANTKLLAIS
PtIP-50Gb  (446)  EG-LEDYNRRQLTRAIFGILGALLQLCASLKFGG-ADIAGGIATTVPAAIDLIHAVQDTSASTKLLAIS
PtIP-50Gc  (446)  EG-LQDYNRRQLTRAIFGILGALLQLCASLKFGG-ADIAGGIATTVPAAIDLIHAVQDDSASTKLLAIS
PtIP-50Gd  (448)  EG-VLDRYRRQVNRAVTGMLGALLQLFASLKFGG-ADIAGAMETTVSAAIDIIHAVEDASASSKLLPMT
PtIP-50Fa  (435)  QG-LQEYEKRQIVTAVTAVISAISLCALGFVTGGATVAAVTGAVANAAQAVSAAVSLANK-----LQKVM
PtIP-50Ff  (445)  EA-IQEYEKKLLARALTSVIGAIASVALAFATGG---ATAPGAVAAGGAVAAAGRLAAG-----LQKVV
PtIP-50Fq  (442)  EA-IQEYEKKLLARALTSVIGAIASVALAVATGG---ATAPGAVAAARGAVTAAGRLAQG-----LQKVV
PtIP-50Fi  (421)  EA-LEAQRRGLARALFAVLGAIAAVALTVATGG---AAAPAVAAAGQAVTAAGTLAQG-----LKTVV
PtIP-50Fj  (454)  QA-IAEYEKKQLANALFAVLGAIASVALAFATAG---ATAPGAVAAAGAAVSAAGRLAEG-----LKKVV
```

```
              771                                                              840
PtIP-50Aa (577) LLELIRVLYIQNAALQYEYLQTP-APLNAWPVTMQTVWGLLVQQETAAINGLLQMGAPS----DYTQEYA
PtIP-50Bd (576) LLELIKVLYIQNAALQYEYLQTP-ARLNAWPVTMQTVWTLLVQQETTAITGLLQLGAPS----DYTQGYV
PtIP-50Bb (576) LLELIRVLYIQNAALQYEYLQTP-APLNAWPVAMQTVWGLLIQQETTAITGLLQLGAPS----DYTQEYV
PtIP-50Ba (577) LLELIQVLNIQNGALRYEYLQPA-APLNAWPVTMQTVWGLLVQQEAAAINGLLQLGAPS----DYTREYV
PtIP-50Bc (576) LVELIRVLNIQNGALRYEYLQPA-APLNAWPVTMQTVWGLLVQQETAAINGLLQLGAPS----DYTREYV
PtIP-50Fb (622) LVELIKVLHMQSVALMYQSLTLP-ELMNAWPVTMETVWRMLIQHEHAAVLGLIRLGPSF----DFRKTLF
PtIP-50Fs (629) LVELIKVLNMQNVALMYQSLTMP-EPMNGWPVTMETVWRMLIQHEHAAVLGLMRLGPSF----DFRKTLF
PtIP-50Fo (672) QVELIKVLDVQNVALMYQSLVKP-ELMNAWPVTMDMVWRLLIQHEHAAVLGLMRLGPSF----DFRKTLF
PtIP-50Fk (668) LVELIKVLDMQNVALMYQSLIMP-EPINAWPVTMETVWGLLIQHEHAAVLGLIRLGPSF----DFRRTFT
PtIP-50Fe (620) LMELIKVLDMQNVALMYQFLTPP-TPMNAWPVTMETVWGMLVQHEHAAVLGLMRLGPAF----DFKRTFT
PtIP-50Fl (589) LMELIKVLDMQNAALMYQFLTLP-APMNAWPVTMETVWGMLVQHEHAAVLGLMRLGPAF----DFRRTFT
PtIP-50Fn (623) LMELIKVLDMQNAALMYQFLSLP-APMNAWPVTMETVWGMLVQHEHAAVLGLMRLGPAF----DFRRTFV
PtIP-50Ft (654) LVALINVVHMQNAALMYQCLSPP-TYVNAWPVTMETVWSMLVQHEHAAVLGLMRLGPSF----DFMRTYV
PtIP-50Fd (663) LVALIKVVNIQNAALMYQYLSEP-TPVYAWPVNMDSVWRMLVQHEQFAIQGLMRLGPAF----DIVRTYV
PtIP-50Fm (669) LVALIKVVNIQNAALMYQYLSEP-TPVYAWPVNMDSVWRMLVQHEQFAIQGLMRLGPAF----DIVRTYE
PtIP-50Fr (665) LVALIKVVNIQNAALMYQYLSEP-TPVYAWPVSMDSVWRMLVQHEQFAVQGLMRLGPAF----DIVRAYV
PtIP-50Fg (674) LVALIKVMYIQNAALMYQYLSEP-TPVSAWPVNMDTVWRMLVQHEQLAIQGLLRLGPAF----DIVRTFV
PtIP-50Fh (676) LVALIRAVHIQNAALMYQYLSEP-IPVSAWPVNMDAVWRILVQHEQSAIQGLLRLGPAF----DIERVFV
PtIP-50Fp (613) LLNLLKVLTLQSGALQFHELLPP--TPFTGWVNMGMVRNALVKHEADAVAAQERLGPST----DYVRTYV
PtIP-50Ga (652) LLSLLNVLAGHQGLHYHYMELEVFTFSWPSVDSVRMHLLQLNQRARARESGLFGNGVLT-VLLEHNYV
PtIP-50Gb (652) LLSLLNVLAGHQGLHYHYMELEVFTSSWPTVDSVRTHLLQLNQRARARENALFGDGVLT-VLLQHDYV
PtIP-50Gc (652) LLSLLNVLAGHQGLHYHYMELEVFTSSWPSVDGVRMHLLQLNQRARARENALFGDGVLT-VLLQHDYV
PtIP-50Gd (654) LLSLLNVLADHQGLHYHYMELQVFTFTWPSVDSVRMHLRLNQWARARENMLFGPGVLT-VEVQQDYV
PtIP-50Fa (637) LFQLIKVLHIQNAALKYEYYAADEHLVSWPVSMETVWTNLQQRLSILGWENLVGTNNLPNDDTRTYV
PtIP-50Ff (644) LLELIKMLYIQNAAIKYEYYDANEKLNSWPVSMETVWTNLQQENAALLGLLDLGPTN----DFTVTYA
PtIP-50Fq (641) LLELIKMLYIQNAAIKYEYYDANEKLNSWPVSMETVWTNLRQENAALLGLLNLGPSN----DFTVTYA
PtIP-50Fi (621) LLQLIKLLHIQNVAINYEYFPANGRLSSWPVTMETVWEMLQQESSAITGLLALGPST----DFARTFV
PtIP-50Fj (654) LLQLIRLLHIQNAAIKYEYYAAGEQLNSWPVSMDTVWSMLQQENSALVGLLDLGPSN----DFTRSFV
```

Fig. 10m

```
              841                                                                          910
PtIP-50Aa (642) VRDVPVRLLGGGDWEFELPVRNAD--FPLTWCRVRIRYVDNRFDAAAE----------HLPVFSTGEV
PtIP-50Bd (641) YENIPVSLLEGRDWEFELPVMNAD--FPTTWCRVRIHVVMQFDAGAK----------HLPSSSTGQV
PtIP-50Bb (641) VKDIPVSLLEGRDWEFELPVLNAD--FPSTWSRVRIHVVDMQFDAAATSI--------HIPTINTGVV
PtIP-50Ba (642) VGDIPVKLLGGGDWEFELPVTDAD--FPLTWCRVRIQHVDMQFDAAAE----------HLPTFSTGEV
PtIP-50Bc (641) VRDIPVRLLGGGDWEFELPVTDDD--FPLTWCRVRIHYVDMQFDAAAE----------HLPTFSTGEV
PtIP-50Fb (687) VKDIPVDLLHGEDWEFEISVDDFT-VFPRTWSRVRIHHLEMKFVGSGDEAAPGGGMQGANQPAIKTGEV
PtIP-50Fs (694) VKDIPVDLLHGEDWEFEISVDDFT-AFPATWSRVRIHHLEMKFVGS-EEAAPWG-MQGPNQPAIKSGEI
PtIP-50Fo (737) VKDIPVDLLHGEDWEFEIPVDDFR-VFPATWSRVRIHHLEMKFAAA-----PAG-TQGANQPAIKSGEI
PtIP-50Fk (733) VKDIPVDLLHGEDWEFEIPVDDFT-VFPVTWSRVRIHHLEMKFVGT-DEAAPAPGLQGTNQPTIKTGEI
PtIP-50Fe (685) VKEIPVDLLHGEDWQFEIPVNERT-VFPSTWSQVRIHHLEMKFVGSNN-----IDHEGSNQPIIESGEV
PtIP-50Fl (654) VKEIPVDLLHGEDWQFEIPVNELT-VFPGTWSQVRIHHLEMKFVGTAEG----SAPNGANLPIIESGEV
PtIP-50Fn (688) VKEIPVDLLHGEDWQFEIPVNELT-VFPGTWSQVRIHHLEMKFVGTAEG----SAPNGANQPIIESGEV
PtIP-50Ft (719) VEGIPVQLLDGEDWEFEISVEDYT-TFPSTWSRVRIHHLEMKFVQAAD---------VEQPIIDTGKV
PtIP-50Fd (728) VKSIPVSLLDGDDYEFEIPVENHI-TFPLSLSRVRIHHLEMRFVQDGDTA-QG---AHVIMPIIDIGSI
PtIP-50Fm (734) VKGIPVSLLDGDDYEFEIPAQDHV-TFPLSLSRVRIHHLEMKFVQGEG--------DQLIMPVIDIGSV
PtIP-50Fr (730) VKSIPVSLLEGDDYEFELPVEDHI-TFPLSLSRVRIHHLEMKFVQGAAGG-SDQGTQIVIMPIIDIGSI
PtIP-50Fg (739) VKSIPVRLLDGDDYQFEIPVEDPL-TFPLSLSRVRIHHLEMKIVQGAH----------VNTPIIAIGKI
PtIP-50Fh (741) VEDIPVSLLEGDDYEFDIPVEDNI-TFPLSLSRVRIHHLEMKFVASGGQ-------KQVIMPVIDSGSV
PtIP-50Fp (677) MSGIPVSLLDGDDWIFTINPLDGS-TFPLSWSRVRIRYLEMKFTGGEE----------FKKPTIDSCKV
PtIP-50Ga (721) LDAIPVSLLSGEDYNFTINPERNASSFPTPWDYVRIRYVEVKFTGE-------------HQPVIKTGEI
PtIP-50Gb (721) LDAIPVSLLSGEDWNFTINPERNASSFPTPWDYVRIRYVEMRFTGE-------------HLPVSEIGEI
PtIP-50Gc (721) LDAIPVSLLSGEDWSFTINPERNASAFPTPWDYVRIRYVDMKFTGE-------------HLVVIDIGEI
PtIP-50Gd (723) VDAIPMSLLSGEDWSFTINPGQNASVFPAPWDYVRIRYVEMKFTGE-------------HHPVSQTGEV
PtIP-50Fa (707) VKDIPVEVLLSGRDWPFVHEEDYT-AFPSGWYYVRINMVLKFEQQTAGS----TDIVIQPSTNIGRL
PtIP-50Ff (710) VKDIPTKLLVDGFDWNFLIAVEDFA-IFPSGLSRVRIRYVELAFDQQGADS----SNIVIQPSTNIGLV
PtIP-50Fq (707) VKDIPVKLLVDGYDWNFLIAVEDFS-IFPSGWSRVRIRYVELAFDQQGTDS----SNIVIQPSTNIGLV
PtIP-50Fi (687) VEDIPVGLLVDGFDWQFAIPVMDDSSAFPIGFSRVRIRYVLAFSAIDIDA----S-ATVQPRIDNGFI
PtIP-50Fj (720) IQGIPIGLLVDGNDWQFSLPVEDSP-TFPIGYSRVRIRYVLIRFDQGTSDE----G-RMIQPSISSGLT
```

```
                981                                                          1038
PtIP-50Aa  (768) SASAPENKGLAFP-TATLAD---ATTRIKITFHVSAIRRISTRVAV-----------
PtIP-50Bd  (767) SASADENKGLAFP-TATSAD---ATTQIKITFHVSAIRRISTFVADPK---------
PtIP-50Bb  (769) SLSAEENAGLAFP-TATSAD---DTTQIKITFHVSAIRRISTRSDGVSS--------
PtIP-50Ba  (768) SSSAPENKGLAFP-TATSAD---ATTRIKITFHVSAIRRISLAR-------------
PtIP-50Bc  (767) STSAPENKDLAFP-TATSDD---ATTRIKITFHVSAIRRISLSR-------------
PtIP-50Fb  (823) SASAQENEGLAFPTATVGAG---DTQIAITFHVSAIREIAL----------------
PtIP-50Fs  (828) SASAQENEGLAFPTATVGAG---HTTQIAITFHVSAIREIAF---------------
PtIP-50Fo  (867) SASAQENEGLAFPTATVGTG---DTTQIAITFHVSAIREIAL---------------
PtIP-50Fk  (868) SASAQENEGLAFPTATACNG---DTTQIAVTFHVSAIREIAL---------------
PtIP-50Fe  (816) SASAQENQGLAFPTTTVGAG---DTTQIAVTFSVSAIREISL---------------
PtIP-50Fl  (786) SASAQENQGLAFPTTTVGAG---DTTQIAVTFYVSAIREISL---------------
PtIP-50Fn  (820) SASAQENQGLAFPTTTVGAG---DTTQIAVTLYVSAIREISL---------------
PtIP-50Ft  (845) SASAEENKGLGFPTATS-AG---STTQIAIIFYISAIRRISL---------------
PtIP-50Fd  (860) SASAEENKGLAFSTATSAD----ATTQIAITFFISAIRQIAL---------------
PtIP-50Fm  (862) SASAEENKGLAFPTATSAD----ATTHIAITFFISAIRQIAL---------------
PtIP-50Fr  (865) SASAEENKGLAFPTATSADA---ATTRIAITFFISAIRQVAL---------------
PtIP-50Fg  (865) SASADENEGLAFPTATSAD----ATTEIAITFHISAIRRISD---------------
PtIP-50Fh  (870) SASAEENKGLAFPTATSAD----ATTQIVVTFHISAVRQVAF---------------
PtIP-50Fp  (803) SASAFENRNLAFPTAANTDLD-AATTQISITFFVTAVRAVDFRSLDDQDM-------
PtIP-50Ga  (843) SASAYQNEGVSFPTLPDLPGAADSPVQITITFYVTALPQIQTS-STDQDPASTT---
PtIP-50Gb  (843) SASAYQNQGVSFPTLPGDPN-SDSPVQITITFFVTALPQIQSR-SLDMSDGDPTEE-
PtIP-50Gc  (843) SASAYQNEGVSFPTIPGDPTSADYPVRITITFYVTALPQIQSRSLLDMST-------
PtIP-50Gd  (845) SASAYQNEGISFPTANSSDT--S--IQITITFYVTALPQIQSL-SEDPAVATTL---
PtIP-50Fa  (839) SASAEENEGLVFHPPSTSPT---STTQVSITFHVTRIRRIRFTSTVHQKHAS-----
PtIP-50Ff  (842) SASAAENQGLVFP-TATSPD---NTTQISITFYVTAIRRILRQEGDVE---------
PtIP-50Fq  (840) SASAMENQGLVFP-TATSPD---NTTQISITFYVTAIRRIHRQEGDEE---------
PtIP-50Fi  (819) SSSAEENRGLIFP-TATSPD---DSTQISITFHITAIRAIDFRGMDDEERSKSDSSQK
PtIP-50Fj  (852) SSSAMENQGLMFP-TATSAD---DTTQITITFFISAIRGIDTRAAVEI---------
```

Fig. 11a

```
              1                                                        50
PtIP-50Aa  (1) MAAGDYSVLYQDVNQISIRLEKMDFSEVMAVHRMFVRMDDLDVSSGTGLL
PtIP-50Ba  (1) MADLDYSKLYQDLNQISVRLEKTEFSEVMVVHRMFVRMDDLDVSSGSGLL
PtIP-50Bc  (1) MADVDYSKLYHDLNQISIRLGNVEFSEVMVVHRMFVRLDDLDVSSGSGLL
PtIP-50Bb  (1) MADIDYSVLYNDVNQISIRLERMDFSEVMAVHRMFVRMDDLDVSSGTGVL
PtIP-50Bd  (1) MAGIDYSVLYQDVNQISIRLEKMDFSEVMAVHRMFVRMDDLDVSSGTGLL 51                                                       100
PtIP-50Aa  (51) SGAEKVKRLYVFADVVELPSKQLRLPGTDLIVILCRIFVTNGRHSTELFL
PtIP-50Ba  (51) SGAEKVKRLYVFADVVELPSKQVRLAGTDMIVVFCRIFVPEGRHYAELFL
PtIP-50Bc  (51) SGAEKVKRLYVFADVVELPSKQVRLAGTDMIVVFCRIFVINGHHGTELFL
PtIP-50Bb  (51) EGAQNVKRLYVFADVVELPSKQVRLPGSDMIVILCRIFVRNGRHNTELFL
PtIP-50Bd  (51) AGAEKVKRLYVFADVVELPSKRVRLPGTDMIIILCRIFVVNGRHSTELFL 101                                                      150
PtIP-50Aa  (101) PSMNMSMVAPG-TGSIRGVILSPTTVLTTSSDALQFKLQSGSMTSVMRLK
PtIP-50Ba  (101) PSMNMSMVGADGEGSIRGVILS-PTVLTTLSNALQFRLECGSMTSVMRLN
PtIP-50Bc  (101) PSTSMSMVAAG-EGSIRGVILS-PTTLTPLSHALQFKLESGSMTSVMRLN
PtIP-50Bb  (101) PSMNMSMVAAG-NGTIRGVNLS-TTMSSSSSNALQFNLRSGSMTSTVRLK
PtIP-50Bd  (101) PSMNLNMVAAG-TGSIRGAYLS-TTAFSLSSNALQFKLQSGSMTSAIQLK
```

Fig. 11b

```
              151                                                    200
PtIP-50Aa (150) DVSVAATLTCNVQAASASMPLTVKTTGTSPGNICVLGMSTAVVPESAVA
PtIP-50Ba (150) DVSAGATLTCNVQAASACVPLKVKTTGTSPGNICVLGLSTAAVVPESVVA
PtIP-50Bc (149) DVSVAATLACNVQAASASMPLKVKTTGTSPGNICVLGMSTDAVVPENVKA
PtIP-50Bb (149) DVDVAAALTCDVQAASASMPLTVMTTGTSPGNIWVLGMTTAVVIPESAVA
PtIP-50Bd (149) DVDLAATLTCDVQAASASMPIVVKTTGTSPGNILVLGMSTAVVIPESAVA 201                                                    250
PtIP-50Aa (200) VITDANILLGMQVTVLIAELVKIAHNSDVLIAAVTRHVEWLNHLLVQAHA
PtIP-50Ba (200) VITDANILLGMQVTVLIAELVKIAHNSDGVIAAVTRHVEWLNHLLVQAQA
PtIP-50Bc (199) VMVDVNILMGMKITVLIAELVKIANNSDAVIAAVTRHVEWLNYLLVQALV
PtIP-50Bb (199) VITDANILLGMQVTVLIAELVKTAHNSDVIIAAITRHVEWLNHLLVQAHA
PtIP-50Bd (199) VITDANILLGMQVTVLIAELVKTAHNSDVVIAAVTRHVEWLNHLLVQAHA 251                                                    300
PtIP-50Aa (250) AAPSEDVVALLYRTQGFIKLRNEGLIVPRLQYRMYKDLIDRMVQVAQSYD
PtIP-50Ba (250) AAPSEDVVALLYRTQAFIKLRKEGLIVPRLQYHMYKDLIDRMVQVAQSYD
PtIP-50Bc (249) AAPSDDVVMLLYRTQALIKLQKEGLIVPRLQYHKYKDLIDRMVQVAQSYD
PtIP-50Bb (249) AAPNEDVITLLYRTQFIKLKREGLVVPRLQYHMYKNLIDRMVQVAQNYD
PtIP-50Bd (249) AAPSDDVVALLYRTQGFIKLQREDLVVPGLQYRMYKDLINRMVQVAQSYD
```

Fig. 11c

```
             301                                                350
PtIP-50Aa (300) QDFKQLKLFVEQNKILGSYLLEQNKAFAEKEKDMDAFHSQVIDLRTSELE
PtIP-50Ba (300) QDFKQMKLYVEQNKILGSYLLEQNKAFAEKEKDMDASHSQVIALRTSELQ
PtIP-50Bc (299) HDFKQLKLYVEQNKILGSYLLDQNKAFAEKEKDMDASHSQLIALRTSELE
PtIP-50Bb (299) QDFRQLKLFVEQNKILGSYLLEQNKAFAEKEKDMDAFHSQIIALRTTELN
PtIP-50Bd (299) QDFKQLKLYVEQNKILGSYLLEQNKAFAEKEKDMDAFHSQVIALRTTELN 351                                                400
PtIP-50Aa (350) STIERMDDLSKQMEEQNAAMEQAKADMDAGLIAYQNKQVANAVFAVLGAI
PtIP-50Ba (350) STIERMDDLSKQMEVQSTAMEKAKADMDAGLIVYQNKQVADAVFAVMEAI
PtIP-50Bc (349) STIERMSDLSKQMEVQSKAMKQAKADMDAGLVEYQDKQVADAVFAVLEAV
PtIP-50Bb (349) NTIERMGELSKQMEQENEAMEQAKADMDAGLIEYQNRQVANALFAVLGAI
PtIP-50Bd (349) NTIERMDDLSKQMEEQNAAMEQAKADMDAGLIEYQNKQVANAVFAVLGAI 401                                                450
PtIP-50Aa (400) ASIGLAFATGGATAPGAVASAGAAVTAAGKAAEGLKKVVEILEGLQAVME
PtIP-50Ba (400) ASIGLAFATGGATAPGAVASAGAAVSAAGKAGEGLKKVVEILEGLQAIME
PtIP-50Bc (399) ASIGLAVATGGASAPEAVASAGAAVSAAGKAAEGLKKVVEVLEGLKAVME
PtIP-50Bb (399) ASIGLAFATGGATAPGAVSAAGAAVTAAGKAAEGLKKVVEILEGLQVVME
PtIP-50Bd (399) ASIGLAFATGGATAPGAVAAAGTAVTAAGKAAEGLKKVVEILEGLQAVME
```

Fig. 11d

```
                451                                                500
PtIP-50Aa (450) VVAVIKELVQSLQEIGQLVDAPEMPDLPSDAEWEIFVNEVEAVAEQMPTE
PtIP-50Ba (450) VIAAIKGLVQSLQKIGQLVNAPEMPDLPSEAEWEMFVKEVEAVAAQMPTE
PtIP-50Bc (449) VIAAINKLVQSIQKIGQLVSAPEMPDLPSDAKWEIFVNEVEAVAAQMPKE
PtIP-50Bb (449) VVAAIKELVQSLQQIGQLVDAPEMPDLPSNADWEIFVNEVEAVAEQMPTE
PtIP-50Bd (449) VVAAIKELVQSLQEIGQLVNAPEMPDLPSNAEWDIFVNEVEAVAEQMPTE 501                                                550
PtIP-50Aa (500) VTEVPAWKAKCKNVAALGREMSTMAAHIAELQFEIQVQEMLREIAKKQAD
PtIP-50Ba (500) VTQVPAWTAKCKNVAALGREMSTTAAHIAELQYEIQVQGMLQQIAKKQAD
PtIP-50Bc (499) VSQVPAWTAKCKNVAALGREMSTTAVHISELQYEIQVQGMLQEIAKKQAE
PtIP-50Bb (499) VTQVAAWKAKCKNVAALGREMSTMAAHIAELQYQIQVQEMLREIAQKQAD
PtIP-50Bd (499) VTEVPAWKAKCKNVAALGREMSTMAAHISELQFEIKVQEMLREIAQKQAD 551                                                600
PtIP-50Aa (550) RLSSIKPADLTNYLEMVSEMDMRTTRMLLELIRVLYIQNAALQYEYLQTP
PtIP-50Ba (550) RLSSIKPADLTNYFEMVSEMDMRTTRMLLELIQVLNIQNGALRYEYLQPA
PtIP-50Bc (549) RLSSIKPADLTNYLEMVSEMDMRTTRMLVELIRVLNIQNGALRYEYLQPA
PtIP-50Bb (549) RLSSISPADLTNYLEMVSQMDMRTTRMLLELIRVLYIQNAALQYEYLQTP
PtIP-50Bd (549) RLSSIKPADLTNYLEMVSEMDMRTTRMLLELIKVLYIQNAALQYEYLQTP
```

Fig. 11e

```
              601                                               650
PtIP-50Aa (600) APLNAWPVTMQTVWGLLVQQETAAINGLLQMGAPSDYTQEYAVRDVPVRL
PtIP-50Ba (600) APLNAWPVTMQTVWGLLVQQEAAAINGLLQLGAPSDFTREYVVGDIPVKL
PtIP-50Bc (599) APLNAWPVTMQTVWGLLVQQETAAINGLLQLGAPSDYTREYVVRDIPVRL
PtIP-50Bb (599) APLNAWPVAMQTVWGLLIQQETTAITGLLQLGAPSDFTQEYVVKDIPVSL
PtIP-50Bd (599) ARLNAWPVTMQTVWTLLVQQETTAITGLLQLGAPSDYTQGYVVENIPVSL 651                                               700
PtIP-50Aa (650) LLGGGDWEFELPVRNADFPLTWCRVRIRYVDMRFDAAAE--HLPVTSTGE
PtIP-50Ba (650) LLGGGDWEFELPVTDADFPLTWCRVRIQHVDMQFDAAAE--HLPTTSTGE
PtIP-50Bc (649) LLGGGDWEFELPVTDDDFPLTWCRVRIHYVDMQFDAAAE--HLPTTSTGE
PtIP-50Bb (649) LLEGRDWEFELPVLNADFPSTWSRVRIHHVDMQFDAAATSIHIPTTNTGV
PtIP-50Bd (649) LLEGRDWEFELPVMNADFPTTWCRVRIHHVEMQFDAGAK--HLPSTSTGQ 701                                               750
PtIP-50Aa (698) VYMLLQSSRFFEDRAKRENEFISYEGGMGLQYQYAYRLATGDATVTNVPS
PtIP-50Ba (698) VYMLLQSSRFFEDRAQHEDEFISYEAGTGLQYQYAYRLATGEATVTNVPS
PtIP-50Bc (697) VYMLLQSSRFFDDRAKHEDEFVSYEAGTGLQYQYAYRLDTGEATVTNVPS
PtIP-50Bb (699) VYLLLQSSRFFDDRARRANEFISYEAGTGLFYQYAYRLATGEATVTNIPT
PtIP-50Bd (697) VYMLLQSSRFFADRAKRANEYINYQAGTGLYYQYAYRLATGEATVTNIPS
```

Fig. 11f

```
           751                                                    800
PtIP-50Aa (748) EEYANTFMRLAPFTRWRLRLSASAPENKGLAFPTATLADATTRIKITFHV
PtIP-50Ba (748) EAYVNTFMLLAPFTRWRLRLSSSAPENKGLAFPTATSADATTRIKITFHV
PtIP-50Bc (747) DAYVNTFMLLAPFTRWRLRLSTSAPENKDLAFPTATSDDATTHIKITFHV
PtIP-50Bb (749) DEYANTFMRLTPFTRWRLRLSLSAEENAGLAFPTATSADDTTQIKITFHV
PtIP-50Bd (747) EEYANTFMRLAPFTRWRLRLSASADENKGLAFPTATSADATTQIKITFHV 801        815
PtIP-50Aa (798) SAIRRISTRVAV---
PtIP-50Ba (798) SAIRRISLAR-----
PtIP-50Bc (797) SAIRRISLSR-----
PtIP-50Bb (799) SAIRRISTRSDGVSS
PtIP-50Bd (797) SAIRRISTFVADPK-
```

Fig. 12a

```
                    1                                                  50
PtIP-50Fb    (1)  ------------------------------------------------MGG
PtIP-50Fs    (1)  ------------------------------------------------MGG
PtIP-50Fe    (1)  ------------------------------------------------MER
PtIP-50Fl    (1)  ---------------------------------------------------
PtIP-50Fn    (1)  ------------------------------------------------MER
PtIP-50Ft    (1)  ------------------------------------------------MAA
PtIP-50Fk    (1)  EIETEKVLIVCERVAYLFLGGWGACSEAPYRAIGILSADQNPHEIFTMGG
PtIP-50Fo    (1)  --RERGVLNGMLTSDHPFWGDWGVCSEA-HRSICLVCPDQSLHEIA-MGG 51                                                 100
PtIP-50Fb    (4)  AVPDYSHLYRELNQVSEGMKLDQMEFSEVMVIHRMFIRLHDLNIAHREGA
PtIP-50Fs    (4)  AVPDYSHMYRELNQVSERMRLDHIEFSEVMVIHRMFIRLPDLDIALQEGA
PtIP-50Fe    (4)  AVPDYSHMYRELNQVSERIRMDQMEFSEVMVIHRMFIRLPDLSIAHLDGA
PtIP-50Fl    (1)  ------------------------MVIHRMFFKLPDLDIAHLDGA
PtIP-50Fn    (4)  AIPDYSHLYRELNQVSERIRMDQMEFSEVMVIHRMFIKFPDLGIAHLEGA
PtIP-50Ft    (4)  AAREYSELYKDLNQISERIRLDQMEFSEVMVIHRMFIRLEELDLGHLEGA
PtIP-50Fk   (51)  AVPDYSHLYRELNQVSERIRLDQMEFSEVMVIHRMFIRLPDLNIAHLEGA
PtIP-50Fo   (47)  AVPDYSHMYRELNQVSERMRLDHMEFSEVMVIHRMFIRLPDLDIALQEGA
```

Fig. 12b

```
                   101                                                       150
PtIP-50Fb   (54)   EQVKRLYVFADVVELSGTS--------LTTLLPGTMMVVILCRVLSVRSF
PtIP-50Fs   (54)   QQVKRLYVFADVVELPETSTSASA-EPVTLRLPGTVMVVILCRVLLFQGS
PtIP-50Fe   (54)   DKVKRLYVFADVVELGSVQ---------QTSSLPGSIMVVIMCRVLTLHVD
PtIP-50Fl   (22)   DKVKCLYVFADVVELGSAG---------QTSNLPGSIMVVIMCRVLTLHAD
PtIP-50Fn   (54)   DKVKCLYVFADVVELGSVR---------QTSSLPGSIMVVIMCRVLTLHLD
PtIP-50Ft   (54)   ERVKRLYVFADVVEVEEGGN--FIETGPLARLPGSIMVVILCRVLSVRVL
PtIP-50Fk   (101)  GQVKRLYIFADVVELGGHL---------VTTQLPGTVMVVILCRVLSLRSP
PtIP-50Fo   (97)   QQVKRLYVFADVVELPEMSTSVTVSETVTLRLPGTVIVVILCRVLFYQG- 151                                                       200
PtIP-50Fb   (96)   -----QSQHGLDFPHMRLHAV-PGDNQMLRIHRRNPDSAQYDDYPVVCVH
PtIP-50Fs   (103)  -----YSAYDLDFPHMRLHAV-PGEAQILRIHRRNPDSAQYDDYPVVCVH
PtIP-50Fe   (96)   PI---ATAYQCDFPHMRLHAF--FGSNGVRIDRRN-SDSVHDDYPVITVS
PtIP-50Fl   (64)   WS---RTSYRFVFPHMRLHAI--FDLQQARIHRRN-SDSVHDDYPVITIS
PtIP-50Fn   (96)   SA---AQAYRIDLPHMRLHAI--NDAQRLRIHRRN-SDSLHDDYPVITIS
PtIP-50Ft   (102)  MFDNGNNAMRLQLPHMKLRVVEITTQPTTKLQIHR-ADAEDYQYPALCIH
PtIP-50Fk   (143)  -----TARYGLNFPHMRLHAVFQSASRILHMERLIPDSAQYDAYPVVCVH
PtIP-50Fo   (146)  -----FARYDLDFPHMRLHAVQPSGAGVLRMHRLNPDSVQYDDYPVVCVL
```

Fig. 12c

```
                      201                                              250
PtIP-50Fb  (140)  ADVLEFPVTG---------GRDIFHLGPLANPCMVITFP----PQSLEEA
PtIP-50Fs  (147)  ADVLEFPVTG---------GRDIFHLGPLANPCMVVTHP----QLSLVEA
PtIP-50Fe  (140)  ANVIEFSGTR---------AETLFAIAPLRDPSMIISS---DLISNTVER
PtIP-50Fl  (108)  ANVIEFSGTRS--------SSVLFGIGVFLDPSMVLS----SDRHSIVER
PtIP-50Fn  (140)  ANVIEFSGTRS--------LRDIFGIGPLQDPSMIITNT--ETQPPVVER
PtIP-50Ft  (151)  ADVIQASIRLSSSSNRPPMDLRFFNFRPNRGSDNVVFSS---ESRSLIDE
PtIP-50Fk  (188)  ADALEFSGTS---------TGGIFHIGPLRYPSMIVTSES----HSAVDA
PtIP-50Fo  (191)  ADVVEFTRQR---------PSRLFRIGPLAYPSMIFTDERPPASSIVEPR 251                                              300
PtIP-50Fb  (177)  PVSSFTGSVRLWTAAASSPH----RIDPNNLTFTPGFMVQQGGSFNLPFN
PtIP-50Fs  (184)  PVSSFTGSVRLWSAATSSPH----SIDPNNLTFTPSFSVQGGGSFNLSFA
PtIP-50Fe  (178)  PASGFFCNVVPNWG-QPSPI----TVDPLRIRFQTGATMVGGGSLT--FP
PtIP-50Fl  (146)  PSSHTLCNVNPVE--QSSPI----MVDPDTIRFQSIFNWVGSNIMSPQVA
PtIP-50Fn  (180)  PSINSLCTVGLVQGQSSSPV----TVDPDRISRHFWFQSVGGGALG--TL
PtIP-50Ft  (198)  PVEIFYVYSHIPRFIHALPIPEAATVDPASRSNDWYYVSLRRVNSTLSSS
PtIP-50Fk  (225)  QISSFSCNVSLRSASASSPL----KINPDNVSFQSMFNLVTGG--GFGFA
PtIP-50Fo  (232)  PVSSFYCTIEFRWSSSNN------IGPNSVGIGCVFRLSGGS--TFSTG
```

Fig. 12d

```
             301                                                      350
PtIP-50Fb (223) TQSE-----DFWLLRRNLPDALLKDSSILLCMQTSMLIAELVEFSHPSSD
PtIP-50Fs (230) TRSE-----DFWLLQRNLPDALLKDSSILLCMQTSMLIAELVEFSHPSSD
PtIP-50Fe (221) LGPE-----GFSILQRNLPDLLLIDPNILLCMQTSMLVAELVEFSHPSSD
PtIP-50Fl (190) RAPE-----GFSLFRRDLPDLLLIDPNILLCMQTSMLIAELVEFSHPSSD
PtIP-50Fn (224) RAAE-----GFSLFQRDLPDVLLIDPNILLCMQTSMLVAELVEFSHPSSD
PtIP-50Ft (248) VAAEGELEPAFSLLKPKIPVVVLTDPNILLAMQTSLLIAELVEVAHPSAE
PtIP-50Fk (269) VRPE-----EFWLLRRDLPDALLNDSSILLCMQTSMLVAELVEFSHPSSD
PtIP-50Fo (273) SPRE-----DFWLFRRDLPDALFKDSSILPCMQTSMLVAELVEFCHPSPD 351                                                      400
PtIP-50Fb (268) VRAAVTLHAEWLNNLLLQASAKS-QGTPHHDDYRALLFRAQYVVKG-IGR
PtIP-50Fs (275) VRAAVTLHAKWLNTLLLQASAKS-EGTPHHADYRALLFRAQYVVKG-VGK
PtIP-50Fe (266) IHAAVTDHVAWLNTHLLQASAKA-QGTSSHDDYLALIFRAQYLLKG-MGR
PtIP-50Fl (235) IHAAVTEHLIWLNTHLLQASTKA-QGTSSYDDYLALIFRSQYLLKG-MGR
PtIP-50Fn (269) IHSAVTEHVVWLNTHLLQASTKA-QGTSSHDDYLALIFRAQYLLKG-MGR
PtIP-50Ft (298) TADAVAKHVEWLNKILLQATKVEGILNSSHDEHLALLFRAQYLMKMRPGR
PtIP-50Fk (314) LHAAIILHAEWLNTLLLQASAAS-QGTSHHDDYLALIFRAQYLIKG-VGR
PtIP-50Fo (318) VRAAIRSHAKWLNTLLLQASVAS-EGTPHHSDYNALLFRAQYVIKG-VGK
```

Fig. 12e

```
                   401                                                450
PtIP-50Fb  (316)   SRGAVVPQLQYDMYSNLINQMARAADSYDQSLKQLKLFIAQNEILGEYLL
PtIP-50Fs  (323)   SRGAVVPQLQYDMYSNLVNQVARAADSYDQSLKQLQLFITQNEILGDYLL
PtIP-50Fe  (314)   ARSLVVPQLQYDVYRNLISQMARVAESYDQSLKQLQLFVAQNKILGGYLL
PtIP-50Fl  (283)   ARSLVVPQLQYDVYRNLINQMARVAESYDQSLKQLQLFLAQNKVLGGYLL
PtIP-50Fn  (317)   ARSLVVPQLQYDVYRNLINQMARVAESYDQSLKQLQLFLAQNKILGGYLL
PtIP-50Ft  (348)   TRNLVVPQLQYDVYSNLVNRMAQVAESYDQSLRQFKLFIDQNKILGSYLL
PtIP-50Fk  (362)   ARGAVVPQLQYDMYSNLINQMARAADTYDQSLKQFQLFVAQNKILGGYLL
PtIP-50Fo  (366)   SRGAVVPQLQYDMYSNLVNQVARAADSYDQSLKQLQLFIAQNEILGEYLL 451                                                500
PtIP-50Fb  (366)   EQNRVFAAKERDMEVFHSELIAQKTTELQTVMVKIDNLSLQMEAQVEDME
PtIP-50Fs  (373)   EQNRVFAAKERDMEVFHSELIAQKKTELLTVMAKIDLLSLQMETQAADME
PtIP-50Fe  (364)   EQNRAFAAKERDMEVFHSELIAQKELELKNTMVKMEQLSLQMETQIADMD
PtIP-50Fl  (333)   EQNRAFAAKERDMEVFHSELIAQKELELQNTMFKMEQLSSQMETQIADMD
PtIP-50Fn  (367)   EQNRAFAAKERDMEVFHSELIAQKELELQNTMFKMEQLSSQMETQIADMD
PtIP-50Ft  (398)   QQNKAFADKERDMDVFHSELISQRKIELDNTILKMDQLSLQMESQREDMD
PtIP-50Fk  (412)   EQNRAFAAKERDMEVFHSELIAQKKTELQTVMVKIDKLSLQMDTQVADME
PtIP-50Fo  (416)   EQNRVFAAKERDMEVFHSELISQKETELRTVVAKIDLLSLQMETQVADME
```

Fig. 12f

```
                    501                                                      550
PtIP-50Fb  (416)  QAREDMEAGLRRFRNRQVANAMFSVFRAIGAVALTVLTGGAAAPLAISAA
PtIP-50Fs  (423)  QAREDMEAGLRRFRNRQVANAMFAVFRAIGAVALTVLTGGAAAPLAISTA
PtIP-50Fe  (414)  QAKEDMDAGLRRFQNRQVANAMFAVFRAIGAIALTVVTAGAAAPAAMAAA
PtIP-50Fl  (383)  QAEKDMEAGLRRFQNRQVARAIFAVFRAIGAVALTVVTGGAAAPAAMSAA
PtIP-50Fn  (417)  QAEKDMEAGLRRFQNRQVARAMFAVFRAIGAVALTVVTGGAAAPAAMTAA
PtIP-50Ft  (448)  QAKKDMDAGLREFQNRQVANAMFAVIGAIAAIGLAFITGGATAPAAVGAA
PtIP-50Fk  (462)  QAREDMEAGLRRFRDRQVANALFSVFRAIGAVALTVLTGGAAAPLAISAA
PtIP-50Fo  (466)  QAREDMEAGLRRFRNRQVANAIFSVFRAIAAVALTVVTGGAAAPLAMSTA 551                                                      600
PtIP-50Fb  (466)  KGAVSIAGQAARGLERVLRILDDLQAAMELLKIIKDLVESLQEIGQLVDA
PtIP-50Fs  (473)  KGAVSIAGQAARGLQRVLQILDDLQAAMELLKIIKDLVESLQEVGQLVDA
PtIP-50Fe  (464)  KGAVTTAGQAARGLVRVLEILDDLQAAMEVFKIIKDLVESLREVGQLVDA
PtIP-50Fl  (433)  KGAVSIAGQAARGLERVLEILDNLQAAMEVFKIIKDLVESLREVGQLVDA
PtIP-50Fn  (467)  KGAVSIAGQAARGLERVLEILDNLQAAMEVFKIIKDLVESLREVGQLVDA
PtIP-50Ft  (498)  KTAVTAAGAAARALERVVEILDSLQAVMEIVSIIKELVSSLQEIGQLVEA
PtIP-50Fk  (512)  KGAVSIAGQAARGLERVLQILDDLQAAMELLKIIKDLVESLQEVGQLVDA
PtIP-50Fo  (516)  KGAVSAAGQAARGLERVLQILDDLQAAMELLKIIKDLLESLQAVGQLVDA
```

Fig. 12g

```
              601                                                650
PtIP-50Fb (516) PDMPEMPTEADWAIFVNEIEGVAEQMPEEVSEVSAWKTSCKNVAAVGREL
PtIP-50Fs (523) PDMPEMPTEADWAIFVNEIEGVAEQMPEEVSEVSAWKTSCKNVAAVGREL
PtIP-50Fe (514) PDMPDMPTEADWSIFVNEIEGVAEQMPEEVSEVSAWKTSCKNVAAVGREL
PtIP-50Fl (483) PEMPDMPTEADWSIFVNEVEAVAEQMPEEVSEVSAWKTSCKNVAAVGREL
PtIP-50Fn (517) PEMPDMPTEADWSIFVNEVEAVAEQMPEEVSEVSAWKTSCKNVAAVGREL
PtIP-50Ft (548) PDMPPMPTEADWFIFENEIEGVAEQMPTEVSEVSAWKTKCKNVAVLGREM
PtIP-50Fk (562) PEMPDMPTEVDWAIFVNEVEGVAEQMPEEVSEVSAWKTSCKNVAVVGREL
PtIP-50Fo (566) PDMPEMPTEADWAIFVNEIEGVAEQMPEEVSEVSAWKTSSKNVAAVGREL 651                                                700
PtIP-50Fb (566) MTTTAYMSQLQYDIQVQAMLQGIASKQADRLSSIQAADLSSFTEMVTEMD
PtIP-50Fs (573) MTTTAYMSQLQYDIQVQAMLQDIASKQADRLSSIQAADLSSFTEMVTQMD
PtIP-50Fe (564) MTTSAYISQLQYDIKVQALLQDIANRQADRLSSIQAADLTSYTEMVTQMD
PtIP-50Fl (533) TTTSAYISQLQYDIKVQAMLQDIANKQADRLSSIQAADLSSYTEMVTQMD
PtIP-50Fn (567) TTTSAYISQLQYDIKVQAMLQDIASRQADRLLSIQAADLSSYTEMVTQMD
PtIP-50Ft (598) ITTATYISELQYDIKVQGMLQEIATSHANRLSSIQATDLSNYTEMVTQMD
PtIP-50Fk (612) TTTSAYMSQLQYDVQVQAMLQDIARKQADRLSSIQAVDLSSFTEMVTQMD
PtIP-50Fo (616) MTTTAYMSQLQYDIQVQAMLQDIASKQADRLSSTQAADLSSFTEMVTQMD
```

Fig. 12h

```
              701                                                   750
PtIP-50Fb (616) MRTTRLLVELIKVLHMQSVALMYQSLTLPELMNAWPVTMETVWRMLIQHE
PtIP-50Fs (623) MRTTRLLVELIKVLNMQNVALMYQSLTMPEPMNGWPVTMETVWRMLIQHE
PtIP-50Fe (614) MRTTRLLMELIKVLDMQNVALMYQFLTPPTPMNAWPVTMETVWGMLVQHE
PtIP-50Fl (583) MRTTRLLMELIKVLDMQNAALMYQFLTLPAPMNAWPVTMETVWGMLVQHE
PtIP-50Fn (617) MRTTRLLMELIKVLDMQNAALMYQFLSLPAPMNAWPVTMETVWGMLVQHE
PtIP-50Ft (648) MRTTRMLVALINVVHMQNAALMYQCLSPPTYVNAWPVTMETVWSMLVQHE
PtIP-50Fk (662) MRTTRLLVELIKVLDMQNVALMYQSLIMPEPINAWPVTMETVWGLLIQHE
PtIP-50Fo (666) MRTIRLQVELIKVLDVQNVALMYQSLVKPELMNAWPVTMDMVWRLLIQHE 751                                                   800
PtIP-50Fb (666) HAAVLGLIRLGPSFDFRKTLTVKDIPVDLLLHGEDWEFEISVDDFTVFPR
PtIP-50Fs (673) HAAVLGLMRLGPSFDFRKTLTVKDIPVDLLLHGEDWEFEISVDDFTAFPA
PtIP-50Fe (664) HAAVLGLMRLGPAFDFKRTFIVKEIPVDLLLHGEDWQFEIPVNERTVFPS
PtIP-50Fl (633) HAAVLGLMRLGPAFDFRRTFIVKEIPVDLLLHGEDWQFEIPVNELTVFPG
PtIP-50Fn (667) HAAVLGLMRLGPAFDFRRTFVVKEIPVDLLLHGEDWQFEIPVNELTVFPG
PtIP-50Ft (698) HAAVLGLMRLGPSFDFMRTYVVEGIPVQLLLDGEDWEFEISVEDYTTFPS
PtIP-50Fk (712) HAAVLGLIRLGPSFDFRRTFTVKDIPVDLLLHGEDWEFEIPVDDFTVFPV
PtIP-50Fo (716) HAAVLGLMRLGPSFDFRKTLTVKDIPVDLLLHGEDWEFEIPVDDFRVFPA
```

Fig. 12i

```
                801                                                      850
PtIP-50Fb (716) TWSRVRIHHLEMKFVGSGDEAAPGGGMQGAHQPATKTGEVYILLQSSRVF
PtIP-50Fs (723) TWSRVRIHHLEMKFVGS-EEAAPWG-MQGPHQPATKSGEIYILLQSSRVF
PtIP-50Fe (714) TWSQVRIHHLEMKFVGSNN-----IDHEGSHQPITESGEVYILLQGSRVF
PtIP-50Fl (683) TWSQVRIHHLEMKFVGTAEG----SAPNGAHLPITESGEVYILLQGSRVF
PtIP-50Fn (717) TWSQVRIHHLEMKFVGTAEG----SAPNGAHQPITESGEVYILLQGSRVF
PtIP-50Ft (748) TWSRVRIHHLEMKFVQAAD----------VHQPITDTGKVYMLLQGSRIF
PtIP-50Fk (762) TWSRVRIHHLEMKFVGT-DEAAPAPGLQGTHQPTTKTGEIYILLQSSRVF
PtIP-50Fo (766) TWSRVRIHHLEMKFAAA-----PAG-TQGAHQPATKSGEIYILLQSSRVF 851                                                      900
PtIP-50Fb (766) HDRNKTKPLHYEAGIPLDYHYAYNLETGETTLSNLPSHDFIRAFMRMTPF
PtIP-50Fs (771) HDRNKTKPLHYEAGIPLDYHYAYNLGTGETTLSNLPSYDFVRAFMRMTPF
PtIP-50Fe (759) HDRNKSELLHYEAAVPLDYHYAYHLETGETTLSNSPSNEFIRTFMRMTPF
PtIP-50Fl (729) HDRNKTEPLHYEAAVPLDYHYAYHLKTGETTLSNSPSNDFIRTFMRMTPF
PtIP-50Fn (763) HDRNKTEPLHYEAAVPLDYHYAYHLKTGETTLSNSPSNDFIRTFMRMTPF
PtIP-50Ft (788) RDRNRADAIRYEAAMSLDYHYAYRLDTGETTLSNLPSQDFTRTFMRMTPF
PtIP-50Fk (811) HDRNNTKPLHYEAGVPLDYHYAYNLETGETTLSNLPSYDFIRAFMRMTPF
PtIP-50Fo (810) HDRNKAEPLHYEAGVPLDYHYAYNLETGETTLSNLPSYDFIRAFMRMTPF
```

Fig. 12j

```
                  901                                           946
PtIP-50Fb  (816)  ATWRLRVSASAQENEGLAFPTATVGAGDTTQIAITFHVSAIREIAL
PtIP-50Fs  (821)  TAWRLRVSASAQENEGLAFPTATVGAGHTTQIAITFHVSAIREIAF
PtIP-50Fe  (809)  TTWRLRVSASAQENQGLAFPTTTVGAGDTTQIAVTFSVSAIREISL
PtIP-50Fl  (779)  TTWRLRVSASAQENQGLAFPTTTVGAGDTTQIAVTFYVSAIREISL
PtIP-50Fn  (813)  TTWRLRVSASAQENQGLAFPTTTVGAGDTTQIAVTLYVSAIREISL
PtIP-50Ft  (838)  TNWRLRLSASAEENKGLGFPTATS-AGSTTQIAIIFYISAIRRISL
PtIP-50Fk  (861)  TTWRLRVSASAQENEGLAFPTATAGNGDTTQIAVTFHVSAIREIAL
PtIP-50Fo  (860)  TTWRLRVSASAQENEGLAFPTATVGTGDTTQIAITFHVSAIREIAL
```

Fig. 13a

```
                       1                                                50
PtIP-50Fd    (1)  -----MAAARSAGANEAWREVYHDLNQVSDRIRLDQLEFSEVMVVHRMHI
PtIP-50Fg    (1)  ------MANDTSSGIVDWRELYRDMNQASDRIRFNQLEFSEVMVIYRMHI
PtIP-50Fh    (1)  ------MASITSGAGADWRELYSEMNQVSERLRLDQLEFSEVMIIHRMHI
PtIP-50Fm    (1)  MQGRLASMAGSAGAADAWREVYRDLNQVSDRIRLDQLEFSEVMVIHRMHI
PtIP-50Fr    (1)  ------MAARSAGAADGWREVYRGLNQVSDRIRFDQLEFSEVMVIHRMHI 51                                               100
PtIP-50Fd    (46) KMSELDIGHLEGAEKVERLYVFADMVECDVPPHASSSDGDLVIRLPGSLS
PtIP-50Fg    (45) KMSELDMGHLEGSEKVKRLYVFADVVEYDAN----G-----IARLPGSIS
PtIP-50Fh    (45) KLSELDIGHLEGADKVKHLYVFADVVELDNAADPSTP---VDVRLPGSIS
PtIP-50Fm    (51) KMSELDIGHLEGAEKVERLYVFADVVELDVVPHESSSDGDVVVRLPGSKS
PtIP-50Fr    (45) KMSELDIGHLAGAEKVERLHVFADVVECDVPPHENSSDPDLVIRLPGSVS 101                                              150
PtIP-50Fd    (96) VIFICRVWHINVGVVQLTS------TVQMSRTLIVQLPHMRWHVNATTGS
PtIP-50Fg    (86) VVFLCREWHVSYHLVARMDRNPPRYQLDLAQGVIISLPHMAWHIDVRRQS
PtIP-50Fh    (92) VVFLCRVWHVSRRLTVGVNSPQYWLPTFDGRPVRIQLPHVKWHMNTLTRS
PtIP-50Fm    (101)VTFVCRVWHINYALVQISS------FARISRSVVLELRHMRWHFNAITGR
PtIP-50Fr    (95) VTFMCRVWHVNYGIVQRTS------TVRVARTVVVQLPHMRLHFNATTGS 151                                              200
PtIP-50Fd    (140)MHRLHPQTSQEGPDTSFCVYAEVVQVAYY---------PDVTFSEFDGSP
PtIP-50Fg    (136)MHRLDPETLQEFLEPSFCVYADDISVAYYSLNGAS-WDPALQFPDTAELA
PtIP-50Fh    (142)MHRIDPETLQDLSGPLLCVYADLLRTSLHPPVGHSNWDAALAFPSMTVLR
PtIP-50Fm    (145)MHLLDPQTLQDGMDLCFCVHAEVVQIAYY---------PDVTFPESNDSP
PtIP-50Fr    (139)MHRLHPQTSQDGSDTCFCVYAEVVQIAYY---------PDVTYPESNDSP
```

Fig. 13b

```
              201                                                250
PtIP-50Fd (181) T-LRFLRLEFESDQLRVTTQT---EGPIWAIRASLDTTMTPDNDGLLNEI
PtIP-50Fg (185) KCALLIYSNSNPTPNHVLLTSNRFNGTRWAFRFEFS-MYYIDNEDVAKDI
PtIP-50Fh (192) EVEVLPCFDHSTPRQGLLTLT---SNAAPQWVNQLRAAFIFTDQDAMTEI
PtIP-50Fm (186) SFLRFLRLEIVPDQLRVTTQT---DGPVWALRGALEYFMAPDNDGLLNEV
PtIP-50Fr (180) VGLRFLRLEFGSDQLRVTRQS---EGPVWALRGSLNYSMSPDNDGLMNEV 251                                                300
PtIP-50Fd (227) SAQPAGTIFKLNILPDNLIVSLFGSLRPNSSTSLTR-VPDNLLPAFSIFR
PtIP-50Fg (234) ALQPPGTRVIFKREGLHLVVLAMDSANRIISFDPERGDLDAYMPAFSLLR
PtIP-50Fh (239) LSLPADASVILNKNRPSIILTAGQSG-----G--YT-DRNVSAPAFSVLR
PtIP-50Fm (233) SSQPAGTSFVLNILPDNLDVQLFANLRPNSGTTLTR-DPNTIVPAFSVYK
PtIP-50Fr (227) SSQPAGTSFILNILPDNLNLQLMASLRRNSNSTLTR-DPDNIVPAFSVYR 301                                                350
PtIP-50Fd (276) EKAV---ELLTDPDVLSAMQTSMLIGELVEVGQPPEATTEVVRKHIEWLN
PtIP-50Fg (284) QDAKFPIELLTDPNILSAMQTSMLIGELVEVGNPSTAVTEVVHKHVKWLS
PtIP-50Fh (281) EGAETPIDSLTDPNFLPAMQTSMLIAELVEVGRPSAAIIEVMHKHVEWLN
PtIP-50Fm (282) EKEG---ELLSDPNILPAMQTSMLIGELVEVGQPPSVTTEVVRKHVEWLN
PtIP-50Fr (276) EKLAV--ELLTDPNTLPPMQTSMLIGELVEVGQPPEATIEVVRKHIEWLN 351                                                400
PtIP-50Fd (323) NLLLKVIEAKQG-QHVEDYVELSFRAQYVIKNVGKIQRMVVPQLQYSAYS
PtIP-50Fg (334) KLLHQVIEEKNG-KDVEDYIGLSFRAQYVIKKVGRIRGLVVPQLQYDVYS
PtIP-50Fh (331) NLLLQVIEAKKGKDVEDYIQLSYRSQYILKNVGRIDRFVVPQLQYDTYS
PtIP-50Fm (329) NLLLQVIEAKRG-EHVEDYVELSFRAQYVIKKVGRIQRLVVPQLQYSAYS
PtIP-50Fr (324) NLLLKVIEAKQG-EPVEDYIELSFRAQYVIKKVGRVQRLVVPQLQYSAYS
```

Fig. 13c

```
              401                                                450
PtIP-50Fd (372) NLINRMAQVAESYDQALRQFKLFIQQN---KILGGFLLEQNRAFAEKEQD
PtIP-50Fg (383) NLINRMAQVAESYDQALRQFRLFIQNN---KILGGFLLEQNRAFAEKEKD
PtIP-50Fh (381) PLINRMAQVAESYDQALRQFRLFIQQTQQNKILGAFLLDQNRAFADKEKD
PtIP-50Fm (378) NLINRLAQVAESYDQALRQFRLFIQQN---KILGGFLLEQNRAFAEKEQD
PtIP-50Fr (373) NLINRLAQVAENYDQALRQFRLFIQQN---KILGGFLLEQNRAFAEREQD 451                                                500
PtIP-50Fd (419) MDVFYSELITQRQIELDNTLQKMKHLGTQMDTQTADMEQAQADMEAG-VR
PtIP-50Fg (430) MDVFYSELITQRQIELDNTLQKLKRLSLQMETQQADMEQAQADMEAG-LR
PtIP-50Fh (431) MDIFYSELIAQRQIELHNTLQKMEQLSLQMETQSADMEQAQADMEAG-LR
PtIP-50Fm (425) MDVFYSELIAQRQIELDNTLQKMKHLGAQMETQTADMEQAQADMEAG-IR
PtIP-50Fr (420) MDVFYSELITQRKIELDNTLQTMKHLGAQMETQTAGMEQAQADMEAAGIR 501                                                550
PtIP-50Fd (468) KFQNEQVARGLFAVLGAIGAVGLTFLTGGAAAPLAISTARRAVSVAGAVA
PtIP-50Fg (479) RFQNRQAARALFAVLGAIAAVGLAFLTGGATAPAALGAARTAVTVAGSVV
PtIP-50Fh (480) RFQNERVARAVFGVLGAIAAVALAFVTGGATAGAAIGAAKTAVTLAGAAA
PtIP-50Fm (474) EFQNRQVARGLFAVLGAIAAVGLTLLTGGAAAPLAMSAARSAVSLAGAVA
PtIP-50Fr (470) RFQNAQVARGLFAVLGAIAAVGLTLLTGGAAAPLAVSAARRVVTVAGAVA 551                                                600
PtIP-50Fd (518) QGLQTVLDILEGLQAVMEIVHLINDLISALQELGQPVELPEMADMPTEAD
PtIP-50Fg (529) SGLQRVLEVLEGLQAVMEIVVIIKDLFSALQDLTQAVDLPDMPEMPLQSD
PtIP-50Fh (530) RGLQQVLEILDGLQAVMEVVGMIKELFESLQELGQAVDLPEMPEMPLESD
PtIP-50Fm (524) QGLQRVLDILEGLQVVMEVVELINDLISSLQELGQPVELPEMAEMPTEAD
PtIP-50Fr (520) QGLQRVIDILEGLQVVMEVVELINDLISSLQDLGQPVDLPEMAELPTQAD
```

Fig. 13d

```
                  601                                                    650
PtIP-50Fd  (568)  WLIFVNEVEGVAEQMPTEVSEVVAWKTKCKNVAVLGREMTTLAAYISQLQ
PtIP-50Fg  (579)  WLIFVNEVEAVAQGMPTEVSEVVAWKTKCKNVAVLGQEMTTAAYISQLQ
PtIP-50Fh  (580)  WHIFVNEVEAVAEQMPTEVSEVVAWKTKCKNVAVLGREMITLATYISQLQ
PtIP-50Fm  (574)  WLIFVNEVEGVAEQMPTEVSEVVAWKTKCKNVAVLGREMTTLAAYISQLQ
PtIP-50Fr  (570)  WLIFVNEVEGVAEQMPTEVSEVVAWKTKCKNVAVLGREMTTLAAYISQLQ 651                                                    700
PtIP-50Fd  (618)  YDIEMQHMLQQIARKQADRLSAIQLPDLRN-YAELVTQMDMRTTRLLVAL
PtIP-50Fg  (629)  YDIMMQDMLQQIARRQADRLSAIQLPDLTN-FTEMVIQMDMRTTRILVAL
PtIP-50Fh  (630)  YDIQMQDMLQQIARKQADRLSAIQLSIPNTGYTEMLMQMDMRTTRLLVAL
PtIP-50Fm  (624)  YDINMQHMLQQIARKQADRLSAIELPDLRN-YGELVTQMDMRTTRLLVAL
PtIP-50Fr  (620)  YDIQMQHMLQQIARKQVDRLSAIQLPDLKN-YAELVTQMDMRTTRLLVAL 701                                                    750
PtIP-50Fd  (667)  IKVVNIQNAALMYQYLSEPTPVYAWPVNMDSVWRMLVQHEQFAIQGLMRL
PtIP-50Fg  (678)  IKVMYIQNAALMYQYLSEPTPVSAWPVNMDTVWRMLVQHEQLAIQGLLRL
PtIP-50Fh  (680)  IRAVHIQNAALMYQYLSEPIPVSAWPVNMDAVWRILVQHEQSAIQGLLRL
PtIP-50Fm  (673)  IKVVNIQNAALMYQYLSEPTPVYAWPVNMDSVWRMLVQHEQFAIQGLMRL
PtIP-50Fr  (669)  IKVVNIQNAALMYQYLSEPTPVYAWPVSMDSVWRMLVQHEQFAVQGLMRL 751                                                    800
PtIP-50Fd  (717)  GPAFDIVRTYVVKSIPVSLLLDGDDYEFEIPVENHITFPLSLSRVRIHHL
PtIP-50Fg  (728)  GPAFDIVRTFVVKSIPVRLLLDGDDYQFEIPVEDPLTFPLSLSRVRIHHL
PtIP-50Fh  (730)  GPAFDIERVFVVEDIPVSLLLEGDDYEFDIPVEDNITFPLSLSRVRIHHL
PtIP-50Fm  (723)  GPAFDIVRTYEVKGIPVSLLLDGDDYEFEIPAQDHVTFPLSLSRVRIHHL
PtIP-50Fr  (719)  GPAFDIVRAYVVKSIPVSLLLEGDDYEFEIPVEDHITFPLSLSRVRIHHL
```

Fig. 13e

```
                801                                              850
PtIP-50Fd (767) EMRFVQDGDTAQG---AHVHMPITDTGSIYILLQGSRNFRDRNEGAILHY
PtIP-50Fg (778) EMKIVQGAH---------VHTPITATGKIYILLQGSRNFHDRNEGKIMHY
PtIP-50Fh (780) EMKFVASGGQ------KQVHMPVTDSGSVYILLQSSRNFHDRNERAVVHY
PtIP-50Fm (773) EMKFVQGEG-------DQLHMPVTDTGSVYILLQGSRNFHDRSEGTILHY
PtIP-50Fr (769) EMKFVQGAAGGSDQGTQIVHMPITDTGSIYILLQGSRNFHDRNESAILHY 851                                              900
PtIP-50Fd (814) EAATPLDYHFAYRLDTGETTVTNLPSAEFLTTFMRMTPFTNWGLRVSASA
PtIP-50Fg (819) EAATALDYQYAYQLDTGETTVTNLPSAEFLRTFTRMTPFTNWRLRLSASA
PtIP-50Fh (824) EAATSLDYHYAYNLETGQIKVTNQPSAEFRKTFMRSTPFTNWRLRLSASA
PtIP-50Fm (816) EAATSLDYHFAYRLDTGETTVTNLPSAEFLRTFMRMTPFTNWRLRVSASA
PtIP-50Fr (819) EAATSLDYHFAYRLDTGASTVTNLPSAEFLTTFMRMTPFTNWRVRVSASA 901                                   936
PtIP-50Fd (864) EENKGLAFSTATSAD-ATTQIAITFFISAIRQIAL-
PtIP-50Fg (869) DENEGLAFPTATSAD-ATTEIAITFHISAIRRISD-
PtIP-50Fh (874) EENKGLAFPTATSAD-ATTQIVVTFHISAVRQVAF-
PtIP-50Fm (866) EENKGLAFPTATSAD-ATTHIAITFFISAIRQIAL-
PtIP-50Fr (869) EENKGLAFPTATSADAATTHIAITFFISAIRQVAL-
```

Fig. 14a

```
              1                                                 50
PtIP-50Ga  (1) MHPRAHDGIS-IPLQQGDDHDAEERQISQMRPRFKAN-VVEDYEEIYRGS
PtIP-50Gb  (1) MHPTGHDGISNIPLEQCHDDYAEE---RQMKPRFETNGLELDYEKIYAGS
PtIP-50Gc  (1) MHPTGHDGIS-IPLEQGDDDYAEES-RQMIRPRFKANGLELDYERIYAGS
PtIP-50Gd  (1) MQQSVHIAARMPGDGEKGRFSSDEEHQMMRPRLTSN-VPEDYEAIYAGS 51                                                100
PtIP-50Ga  (49) NSIAREVGVSKVNCGEVMAIHRMFFRLDTLSQELLRQPERVQRLIVVADV
PtIP-50Gb  (48) NSIAREVGLDKVNCGEVMAIHQMFFRLDTLSQELLRRPELVKRLIVVADV
PtIP-50Gc  (49) NSIAREVGLNKVICGEVMAIHRMFFRLDTLSQELLRQPELVKRLVVVADV
PtIP-50Gd  (50) NSITREVGVNKVRCGELMAIHQMFFRLDTLSQELLQQPQLVKHLIVVADV 101                                               150
PtIP-50Ga  (99)  VEIEGSNDTLSLPGSSLVLVLCRILILKSKDVVLDLTSWDLTVATTT-PL
PtIP-50Gb  (98)  VEIEGSNATLSLPGSSLVLIFCRILILKSRNLVLDLDNWNLRAASTT-PL
PtIP-50Gc  (99)  VEIEGANATLSLPGSSLVLIFCRILILKSRDVVLDLSNWDLRVATTT-PL
PtIP-50Gd  (100) VEIEGSRGTLVLPGSSLVLIFCRILVLKSKDVVLDLGSWDLSVATTSSPL 151                                               200
PtIP-50Ga  (148) HRCSIHAQRVVVASG-SLSASLLIQVKHKFEWSDGTHLDQYFGRPFSFIA
PtIP-50Gb  (147) HRCSIRAQRVVIASGFSLYSSLLIQVKHKFEWSDGTHLDQYFGRPFYFTA
PtIP-50Gc  (148) HRCSIRAQRVVVASG-SLSASLLIQVKHKFEWSDGTHLDQYFRRPISFTA
PtIP-50Gd  (150) VRCSIRAQQVVISSG-SLSASLLIQAKHRLRWSDGSHLDQYFGRPFSFAS
```

Fig. 14b

```
              201                                                250
PtIP-50Ga (197) SEINSSATATTRINSAMRSISTWPGTAPVSNFIRVNSEKFNVLVNAVPWK
PtIP-50Gb (197) IGINSSATTTTTATSAMRSINTWPGTAPVSNFIRVNSEKFNVLVNAVPWK
PtIP-50Gc (197) SRINSSAAITTRTTSATRSINTWPGTAPVSNFIQVNSEKFNVLVNAVPWK
PtIP-50Gd (199) SKINSFATTTTQTSYAKQSISTWPGVPPTSNLIVVNSETFNVRVNAVPWK 251                                                300
PtIP-50Ga (247) GVVDCQASLPSLDDLLHPDVISGIQSTLLIVETILNFQTDNPAIIILAQQ
PtIP-50Gb (247) GVIDCQAALPSLDDLLHPDVISGFQSTLLIVETILNFQTDNPAIISLARQ
PtIP-50Gc (247) GVVDCQAALPSLDDLLHPDVISGIQSTLLIVETILNFQTDNPDIIVLARQ
PtIP-50Gd (249) GVVDCQTALPSSDDLLHPHVISGIQSTLLIVETILNFQTSNPSIIVLAQQ 301                                                350
PtIP-50Ga (297) HAEWIVDSLLQVVHLPDSTFGVAEVKTLLARAQMLMKLPTDGSQHLQVPL
PtIP-50Gb (297) HAEWILDSLLQVVPLPDSTLGVPEAKTLLARAQILMKLPTDGSQHLRVPL
PtIP-50Gc (297) HAEWIVDSLLQVVPLPNSTLGVPEVKTLLARAQMLIKLPTDGSQHLRVPL
PtIP-50Gd (299) HAQWIVDSLLQAVHLPNSTTGVPELKTLLARSQMVVKLPIDGSQHLKVPL 351                                                400
PtIP-50Ga (347) LAYGEYQEDIDQLLRNAEAYDQEYRELTRFVQQVEIIGNEFLQLSRSLAE
PtIP-50Gb (347) LAYGEYQEDIERLLRNAEAYDQEYRELTRFVQLVEIIGSEFLQLSRSLAQ
PtIP-50Gc (347) LAYGEYQEDIERLLRNAEAYDQEYRALTRFVQLVEIIGSEFLQLSKTLAQ
PtIP-50Gd (349) LVYGEFQEDIDQLLRNAEAYDQEYRQLTRFVQQVQIIGSEFLQLSMSLAQ
```

Fig. 14c

```
              401                                                450
PtIP-50Ga (397) KERQIEIFESLVVIRKQSELDQAIRRMNSLMTEIERRSYEMADARSEMEQ
PtIP-50Gb (397) RERDIEAFESLAVIRKQSELDQAIRRMNSLMPEIERRSFEMADAKARMEE
PtIP-50Gc (397) RERDIETFESLVVIRKQSELDQAIRRMNSLMTEIERRSFEMADAKARMEE
PtIP-50Gd (399) KERQIETFQSLLVIRKQSELDQTMRRIDSLMREIERRSFEMADARYRMEE 451                                                500
PtIP-50Ga (447) GLEDYHRRQLTRAIFGILGALLQLCASLKFGGGADIAGGIATTVPAAIDM
PtIP-50Gb (447) GLEDYNRRQLTRAIFGILGALLQLCASLKFGGGADIAGGIATTVPAAIDL
PtIP-50Gc (447) GLQDYNRRQLTRAIFGILGALLQLCASLKFGGGADIAGGIATTVPAAIDL
PtIP-50Gd (449) GVLDHYRRQVNRAVFGMLGALLQLFASLKFGGGADIAGAMETTVSAAIDI 501                                                550
PtIP-50Ga (497) IHAVEDASANTKLLAISQSLMDLEKIVDVVNAVNALVESATELEDIIHAP
PtIP-50Gb (497) IHAVQDTSASTKLLAISQTLMDLEKIVDVVNAVNTLAESATELEDIVHAP
PtIP-50Gc (497) IHAVQDDSASTKLLAISQTLMDLEKIVDVVNAVNELVESATELEDIIHAP
PtIP-50Gd (499) IHAVEDASASSKLLPMTKNLIDLEKMIEVVNAVNELVENATELEDIIHAP 551                                                600
PtIP-50Ga (547) ELPLIPPYTWDIMENDIEEFAALMPSEVSEVVTWKAKCRNLVAVCREICI
PtIP-50Gb (547) ELPLIPPYTWDILENDIEEFAALMPLEVSEVVTWKAKCRNLVAVCREICI
PtIP-50Gc (547) ELPIILPYTWDILENDIEEFAALMPSEVSEVVTWKAKCRNLVAVCREICI
PtIP-50Gd (549) ELPIISSYTWDILENDIDELAALMPSEVSEVVTWKAKCRNLVAVCREICI
```

Fig. 14d

```
              601                                              650
PtIP-50Ga (597) AASFACEVQYELFVHARQQEMARRQAERLEGMQIAADLSSYIELATQADM
PtIP-50Gb (597) AASFACEVQYELFVHARQQEMARRQAERLEGMQTAADLSSYIELATQADM
PtIP-50Gc (597) AASFACEVQYELFVHARQQEMARRQAERLEGMQTAADLSSFIELATQADM
PtIP-50Gd (599) AANFAAEVQYELFVHARQQEMARRQAERLEGMQLATDLSSYIELATQADM 651                                              700
PtIP-50Ga (647) RTTRLLLSLLNVLAGHQGALHYHYLMELEVFTFSWPSVDSVRMHLLQLNQ
PtIP-50Gb (647) RTARLLLSLLNVLAGHQGALHYHYLMELEVFTSSWPTVDSVRTHLLQLNQ
PtIP-50Gc (647) RTTRLLLSLLNVLAGHQGALHYHYLMELEVFTSSWPSVDGVRMHLLQLNQ
PtIP-50Gd (649) RTTRLLLSLLNVLADHQGALHYHYLMELQVFTFTWPSVDSVRMHLLRLNQ 701                                              750
PtIP-50Ga (697) RARARESGLFGNGVLTVDLEHNYVLDAIPVSLLLSGEDYNFTINPERNAS
PtIP-50Gb (697) RARARENALFGDGVLTVDLQHDYVLDAIPVSLLLSGEDWNFTINPERNAS
PtIP-50Gc (697) RARARENALFGDGVLTVDLQHDYVLDAIPVSLLLSGEDWSFTINPERNAS
PtIP-50Gd (699) WARARENMLFGPGVLTVEVQQDYVVDAIPMSLLLSGEDWSFTINPGQNAS 751                                              800
PtIP-50Ga (747) SFPTPWDYVRIRYVEVKFTGEHQPVTKTGEIYLVLRSSANFQDRLEEQVF
PtIP-50Gb (747) SFPTPWDYVRIRYVEMRFTGEHLPVSETGEIYLLLRSSANFQDRLEEQVL
PtIP-50Gc (747) AFPTPWDYVRIRYVEMKFTGEHLPVTDTGEIYLLLRSSANFQDRLEEQVF
PtIP-50Gd (749) VFPAPWDYVRIRYVEMKFTGEHHPVSQTGEVYLLLQSSANFQDRFEGQVL
```

Fig. 14e

```
              801                                                    850
PtIP-50Ga (797) EYEAAVPLVYQYAYNLSTGATTLPNLPSQSGKFFRMTPFTRWRLRLSASA
PtIP-50Gb (797) EYEAAVPLVYQYAYNLSTGATTLPNQPSESGKFFRMTPFTRWRLRLSASA
PtIP-50Gc (797) EYEAAVPLVYQYAYNLSTGETTLPNLPSESGKFFRMTPFTRWRLRLSASA
PtIP-50Gd (799) EYEAAVPLVYQYAYNLTTGATTLPNLPFESGKFFRMTPFTRWRLRLSASA 851                                                    900
PtIP-50Ga (847) YQNEGVSFPTLPDLPGAADSPVQITITFYVTALPQIQTS-STDQDPASTT
PtIP-50Gb (847) YQNQGVSFPTLPGDPN-SDSPVQITITFFVTALPQIQSR-SLDMSDGDPT
PtIP-50Gc (847) YQNEGVSFPTIPGDPTSADTPVRITITFYVTALPQIQSRSLLDMST----
PtIP-50Gd (849) YQNEGISFPTANSSDT--S--IQITITFYVTALPQIQSL-SEDPAVATTL

901
PtIP-50Ga (896) ---
PtIP-50Gb (895) EE-
PtIP-50Gc (893) ---
PtIP-50Gd (894) ---
```

Fig. 15a

```
              1                                                  50
PtIP-50Fa  (1) MEYSALYGDVNQVSLRFEKTEFSEVVVVHRMHVRLAELNVTLGDNNILLQ
PtIP-50Ff  (1) MEYSSLYGDVNQVSLRFQNMEFSEVMVVHRMHVRLEELDMTG------LE
PtIP-50Fq  (1) ---------VNQVSLRFQNMEFSEVMVVHRMHVRLEELDMTG------VE
PtIP-50Fi  (1) MEYSDLYHDVNMISLPLHRTELSEVMVVHRMHVKLRDLNIET-------A
PtIP-50Fj  (1) MEYSDLYADVNQVSLRFQQTEFSEVMVVHRMYVRLLDLDMTTEPHLQMLA 51                                                 100
PtIP-50Fa (51) GSDRVKRLYVLADVVELPP---IFSTSMSLPGTVSVVILCRILYLPYLED
PtIP-50Ff (45) GIEKVKRLYVLADVVELPSTATQVFQYLRLPASISAIILCRVLYIPEVDQ
PtIP-50Fq (36) GIEKVKHLYVLADVVELPPKATSVFEYVRLPATISAIILCRVLYIPEVQR
PtIP-50Fi (44) VSDKVHRLYVVADVVEV------TLDTVSLPCKVSVVILCRVLHVE--QS
PtIP-50Fj (51) GSEKVRRLYVVADVVELP----ATATNMRLPATASVVILCRVLYVQDVNS 101                                                150
PtIP-50Fa (98) ASSASG---WAVHAALLRLRVVEMHAGFAQVFTIPANDSSAAAPADIGLY
PtIP-50Ff (95) RP---HMAQCSLDFPFMRLHVVGSAH-ENGGGVMQAFSSD-ATPSNIGIY
PtIP-50Fq (86) LSGAGFRGQCSLDFPFMRLHVVGAAH-ESGGGVMQAFSSD-ATAGNIGVY
PtIP-50Fi (86) SVLF-----SSLLLPNMNVRVVLSN---NRMQVYPMATDG--SADDVALY
PtIP-50Fj (97) PYLA-----CGLHFPLMPLRVVEDTQ-QGRVHVFPVVGGESASVDKIGLY 151                                                200
PtIP-50Fa (145) IHADRIIYRDD-PGRSIPVIEVRVGGDSRFSPFLP---GSP--EIRLSSV
PtIP-50Ff (140) FHADRFIYRQATSSASNFVLPLDVRVSFGSSTFSAPTLRPDWQNLNVSNI
PtIP-50Fq (134) LHADRFIYREAASPASDFVWPLDVRVSFGSSTFSN-TAVPDWQNLNVSSI
PtIP-50Fi (126) IHADRVIRRQG-AWTLVRVMHMSITGPE-----STFSVPHLPDPALFNRV
PtIP-50Fj (141) IHADRVVYRQD-TSTANPLQPLQLRVIGNGSTFSTEVRPDWPKTLEVSSL
```

Fig. 15b

```
              201                                                250
PtIP-50Fa (189) QYVREFSK-GQPVAPEDSELQRSDEIELIAP----------SGSEQQLRA
PtIP-50Ff (190) QYGPQHLSRGPPLTSSDSDLQRSDEIELLAQQDVWSPLLHVAFSPNAPPG
PtIP-50Fq (183) RYDSQRLSKGPPLTSSDSDLQRSDEIELLAQQDIWSPILHVSFNPNAPPG
PtIP-50Fi (170) MVNVQMDA-GPSIPASESDLQRSDETELVS-------RVSNGVTVSASIA
PtIP-50Fj (190) LMWLTLSK-GQPIPAAESDLQRHDEVELLSPPSPD--RLSVVFAYLAPGN 251                                                300
PtIP-50Fa (228) AFGASVGMNLLFHFSSSFDILSLDPVPAALLTDPNIITGMQMNMLIAELV
PtIP-50Ff (240) NIPGTQGIFRPSSACSFFHVPPPD-VPANVLTDPSIILGMQMNMLIAELV
PtIP-50Fq (233) NVPGTQGLFRPSSACSFFHVPPPD-VPANVLTDPSIILGMQMNMLIAELV
PtIP-50Fi (212) GSAWTMPADNPSATFTVFPNPPAQPVARGVLTNPYVIIGLQMNMLTAELV
PtIP-50Fj (237) LFSIAVDVEYIGAGFCYFRIPPADPVPTEVLTDPYVIIGLQMNMLIAELV 301                                                350
PtIP-50Fa (278) LTAAHNSPQLIKVVTRHVEWLNKMF-----------LQLASPNDDILALL
PtIP-50Ff (289) LAAHN-SPQVMNVITKHVLWLNKIL-----------LQVASPNDDILALL
PtIP-50Fq (282) LAAHN-SPQVMNVVTKHVLWLNKIL-----------LQVASPNDDILALL
PtIP-50Fi (262) QAAHN-APLLIRAVTRHVEWLNKIL--------VEALQVVSGNEDLLALL
PtIP-50Fj (287) LAAHN-SPPVISVVTKHVEWLNKILPNDDILALLFRVQLSLPNDDILALL 351                                                400
PtIP-50Fa (317) FRVQAYQKMAKQP----HPVVPRMRYSRYEGLINQMVQIAQSYDQDLKQL
PtIP-50Ff (327) FRIQAFMKMAKEP----RFVVPRLQYHMYGSLINRMVQVAQNYDQEFKQL
PtIP-50Fq (320) FRIQAFMKMAKQPRFVPRFVVPRLQYHMYGSLINRMVQVAQNYDQEFKQL
PtIP-50Fi (303) FRTETYLKMATES----RSVVPRLQYHMYSDLIHRMVQVAQAYDDEFQRL
PtIP-50Fj (336) FRVQAFLKMAKQP----RSVVPRLQYHMYSPLINRMVQVAQVYDQEFKQL
```

Fig. 15c

```
                401                                              450
PtIP-50Fa (363) KLFIAQNEILGSYLLEQNKAFAAKEKSMSEFHLQVSDLRRSELNDAIQKM
PtIP-50Ff (373) KLFIAQNKILGSYLLQQNRAFAEREREMSAFHSQVVSMRRSELQSAIQTM
PtIP-50Fq (370) KLFIAQNEILGSYLLQQNKAFAEREKEMSAFHSQVVSMRRSELTTAIETM
PtIP-50Fi (349) RLFIAQNEILGSYLLEQNKALASREREMSAFHSQVVSLRRTELDNCLQRM
PtIP-50Fj (382) KLFIVQNQILGSYLLEQNKAFASRETEMSSFHSQVVSLRRTELNNAIDRI 451                                              500
PtIP-50Fa (413) TGLGEEMEVEKEAMDQAYKDMEQGLQEYEKRQIVTAVFAVISAISLCALG
PtIP-50Ff (423) DNLSLQMESESEAMNEAQENMVEAIQEYERKLLARALFSVIGAIASVALA
PtIP-50Fq (420) NQLSLQMETESEAMNEAQENMVEAIQEYERKLLARALFSVIGAIASVALA
PtIP-50Fi (399) DQLNVQMERENKAMEEAQEKMNEALEAHQRRGLARALFAVLGAIAAVALT
PtIP-50Fj (432) DQLSVQMENENEAMDQAKEDMMQAIAEYEKKQLANALFAVLGAIASVALA 501                                              550
PtIP-50Fa (463) FVTGGATVAAVPGAVANAAQAVSAAVSLANKLQKVMGILEIINQVVQTAA
PtIP-50Ff (473) FATGG---ATAPGAVAAAGGAVAAAGRLAAGLQKVVDILQGLQAVMEVVV
PtIP-50Fq (470) VATGG---ATAPGAVAAARGAVTAAGRLAQGLQKVVDILQGLQAVMEVVV
PtIP-50Fi (449) VATGG---AAAPAAVAAAGQAVTAAGTLAQGLKTVVEILEGLQALMDLVV
PtIP-50Fj (482) FATAG---ATAPGAVAAAGAAVSAAGRLAEGLKKVVEILEGLAAVMEIVA 551                                              600
PtIP-50Fa (513) AIKEVIELFDNMGQLLEAPEMPEMPSNYDWLIFVNEVEAMAEQLPVEVN-
PtIP-50Ff (520) AIRDIVESLKNMGQLVEAPEMPEMPTDADWLIFVNEVEAVAEQVPTEVA-
PtIP-50Fq (517) AIRDIVESLKNMGQLVEAPEMPEMPTDADWLIFVNEVEAVAEQVPTEVA-
PtIP-50Fi (496) IIRELVENLQTIGQLIDAPEMQEMPSNADWLIFVNEVEAVAAQMPEEVFG
PtIP-50Fj (529) AIRDLVESLQNLGQLVETPEMPDMPSNADWLIFVNEVEAVAEQMPAEVVG
```

Fig. 15d

```
                 601                                                      650
PtIP-50Fa (562)  ERIVWKAKCKNVAVLGQEMCTTGSHIADLQYQIKVEEMLREIAQSQAERL
PtIP-50Ff (569)  EVPVWKAKCKNVAVLGQAMCTTAAYISELQYQITVEEMLQEIAQRQADRL
PtIP-50Fq (566)  EVPVWKAKCKNVAVLGQAMCTTAAYMSELQYQITVEEMLQEIAQRQADRL
PtIP-50Fi (546)  SVAVWKAKCRNVAVLGQEMCTMAAHIAELQQQIKLEELLQEIADRQADRL
PtIP-50Fj (579)  SVAVWKAKCRNVAVLGQEMCTTAAHIGELTYQIKVEEMLQEIAQRQANRL 651                                                      700
PtIP-50Fa (612)  EGISSADLSSYTEMVSQIDMRTTRLLFQLIKVLHIQNAALKYEYLYAADE
PtIP-50Ff (619)  VGISAADLSSYTEMASQIDMRTTRILLELIKMLYIQNAAIKYEYLYDANE
PtIP-50Fq (616)  VGISAADLSSYTEMASQIDMRTTRILLELIKMLYIQNAAIKYEYLYDANE
PtIP-50Fi (596)  LGISAADLSSFTEMLTQIDMRTTRLLQLIKILLHIQNVAINYEYLFPANG
PtIP-50Fj (629)  ESLTPANLSSYTEMLSEIDMRTTRLLLQLIRLLHIQNAAIKYEYLYAAGE 701                                                      750
PtIP-50Fa (662)  HLVSWPVSMETVWTMLLQQQRLSLLGWENLVGTNNLPNDDTRTYVVKDIP
PtIP-50Ff (669)  KLNSWPVSMETVWTMLLQQENAALLGLLDLGPTN----DFTVTYAVKDIP
PtIP-50Fq (666)  KLNSWPVSMETVWTMLLRQENAALLGLLNLGPSN----DFTVTYAVKDIP
PtIP-50Fi (646)  RLSSWPVTMHTVWEMLLQQESSAITGLLALGPST----DFARTFVVHDIP
PtIP-50Fj (679)  QLNSWPVSMDTVWSMLLQQENSALVGLLDLGPSN----DFTRSFVIQGIP 751                                                      800
PtIP-50Fa (712)  VEVLLSGRDWPFVIHEEDYT-AFPSGWYYVRINHVELKFEQQTAGSTDIV
PtIP-50Ff (715)  TKLLVDGFDWNFEIAVEDFA-IFPSGLSRVRIRYVELKFDQQGADSSNIV
PtIP-50Fq (712)  VKLLVDGYDWNFEIAVEDFS-IFPSGWSRVRIRYVELKFDQQGTDSSNIV
PtIP-50Fi (692)  VGLLVDGFDWQFAIPVMDDSSAFPIGFSRVRIRHVELKFSAIDIDAS-AT
PtIP-50Fj (725)  IGLLVDGNDWQFSIPVEDSP-TFPIGYSRVRIRYVELRFDQGTSDEG-RM
```

Fig. 15e

```
             801                                                       850
PtIP-50Fa (761) IHQPSTNTGRLYMLLQSSRFFHDRNQGVKMEYEGSRGLSYPYAYNLNTGE
PtIP-50Ff (764) IHQPSTNTGLVYMLLQGSRFVHDRKRQEVMDYEASTGPVYAYAYDLNTGA
PtIP-50Fq (761) IHQPSTNTGLVYMLLQGSRFLHDRKREEVMDYEASMGAVFAYAYDLNTGA
PtIP-50Fi (741) VHQPRTDNGFIYILLQSARSFSDRRVRQAMDYEASEGLAYPYAYNLTTGV
PtIP-50Fj (773) IHQPSTSSGLTYMLLQSSPVFRDRRREVLEYEASMGLAYAFAYNLTTGV 851                                                       900
PtIP-50Fa (811) TTHNNIPSDQFKNIFMQMTPFT-TWRLRLSASAEENEGLVFHPPSTSPTS
PtIP-50Ff (814) TTLNNIPSQQQANTFMQMTPFN-AWRLRLSASAAENQGLVFP-TATSPDN
PtIP-50Fq (811) TTLSNIPSQQHANTFMQMTPFNAAWRLRLSASAMENQGLVFP-TATSPDN
PtIP-50Fi (791) PSLTNLPSQEHANTFMRMTPFT-EWRLRLSSSAEENRGLTFP-TATSPDD
PtIP-50Fj (823) PTLTNVPSPEFANTFMRMTPFNSNWRLRLSSSAMENQGLMFP-TASSADD 901                          934
PtIP-50Fa (860) TTQVSITFHVTRIRRIDRFTSTVHQKHAS-----
PtIP-50Ff (862) TTQISITFYVTAIRRIDLRQEGDVE---------
PtIP-50Fq (860) TTQISITFYVTAIRRIDHRQEGDEE---------
PtIP-50Fi (839) STQISITFHITAIRAIDFRGMDDEERSKSDSSQK
PtIP-50Fj (872) TTQITITFFISAIRGIDTRAAVEI----------
```

Fig. 16a

```
                           *        20         *        40         *
IPD050Fb : ------------------------------------------------MGG :  3
IPD050Fs : ------------------------------------------------MGG :  3
IPD050Fo : --RERGVLNGMLTSDHPFWGDWGVCSEA-HRSICLVCPDQSLHEIA-MGG : 46
IPD050Fk : EIETEKVLIVCERVAYLFLGGWGACSEAPYRAIGILSADQNPHEIFTMGG : 50
IPD050Fe : ------------------------------------------------MER :  3
IPD050Fl : ------------------------------------------------MER :  3
IPD050Fn : ------------------------------------------------MER :  3
IPD050Ft : ------------------------------------------------MAA :  3
IPD050Fh : -------------------------------------------MASITSG :  7
IPD050Fg : -------------------------------------------MANDTSS :  7
IPD050Fm : ------------------------------------MQGRLASMAGSAG  : 13
IPD050Fd : ---------------------------------------MAAARSAG    :  8
IPD050Fr : ----------------------------------------MAARSAG   :  7
IPD050Bb : -------------------------------------------------M :  1
IPD050Bd : -------------------------------------------------M :  1
IPD050Aa : -------------------------------------------------M :  1
IPD050Ba : -------------------------------------------------M :  1
IPD050Bc : -------------------------------------------------M :  1
IPD050Fa : -------------------------------------------------- :  -
IPD050Ff : -------------------------------------------------- :  -
IPD050Fq : -------------------------------------------------- :  -
IPD050Fi : -------------------------------------------------- :  -
IPD050Fj : -------------------------------------------------- :  -
IPD050Fp : ------------------------------------------------MA :  2
IPD050Gd : -------------MQQSVHIAARMPGDGEKGRFSSDEEHQMMMRPRLTSN- : 37
IPD050Ga : -------------MHPRAHDGIS-IPLQQGDDHDAEERQISQMRPRFKAN- : 36
IPD050Gb : -------------MHPTGHDGISNIPLEQCHDDYAEE---RQMKPRFETNG : 35
IPD050Gc : -------------MHPTGHDGIS-IPLEQGDDDYAEES-RQMIRPRFKANG : 36
IPD050Fb : ------------------------------------------------CCC :  3
IPD050Fs : ------------------------------------------------CCC :  3
IPD050Fo : --CCCCCCCCCCCCCCCCCCCCCCCCC-CCCEEEECCCCCHHHHH-HCC : 46
IPD050Fk : CCCCCEEEEEEHHHHHHHHCCCCCCCCCCCCCCCCCCCCCCCCEEECCC : 50
IPD050Fe : ------------------------------------------------CCC :  3
IPD050Fl : ------------------------------------------------CCC :  3
IPD050Fn : ------------------------------------------------CCC :  3
IPD050Ft : ------------------------------------------------CHH :  3
IPD050Fh : ---------------------------------------------CCCCCCC :  7
IPD050Fg : ---------------------------------------------CCCCCCC :  7
IPD050Fm : -----------------------------------CCCCCCCCCCCCC : 13
IPD050Fd : ----------------------------------------CHHHHCCC :  8
IPD050Fr : -----------------------------------------CCCCCCC :  7
IPD050Bb : -------------------------------------------------C :  1
IPD050Bd : -------------------------------------------------C :  1
IPD050Aa : -------------------------------------------------C :  1
IPD050Ba : -------------------------------------------------C :  1
IPD050Bc : -------------------------------------------------C :  1
IPD050Fa : -------------------------------------------------- :  -
IPD050Ff : -------------------------------------------------- :  -
IPD050Fq : -------------------------------------------------- :  -
IPD050Fi : -------------------------------------------------- :  -
IPD050Fj : -------------------------------------------------- :  -
IPD050Fp : ------------------------------------------------CC :  2
IPD050Gd : -------------CCCCEEEEECCCCCCCCCCCCHHHHHHHCCCCCCCC- : 37
IPD050Ga : -------------CCCCCCCCCC-CCCCCCCCCCHHHHHHHHCCCCCCCC- : 36
IPD050Gb : -------------CCCCCCCCCCCCCCCCCCCCHHHH---HCCCCCCCCCC : 35
IPD050Gc : -------------CCCCCCCCCC-CCCCCCCCCHHHHH-HHHCCCCCCCCCC : 36
```

Fig. 16b

```
          [ motif 23  ][        motif 8           ]
                        60         *        80         *        100
IPD050Fb : AVPDYSHLYRELNQVSEGMKLDQMEFSEVMVIHRMFIRLHDLNIAH---- :  49
IPD050Fs : AVPDYSHMYRELNQVSERMRLDHIEFSEVMVIHRMFIRLPDLDIAL---- :  49
IPD050Fo : AVPDYSHMYRELNQVSERMRLDHMEFSEVMVIHRMFIRLPDLDIAL---- :  92
IPD050Fk : AVPDYSHLYRELNQVSERIRLDQMEFSEVMVIHRMFIRLPDLNIAH---- :  96
IPD050Fe : AVPDYSHMYRELNQVSERIRMDQMEFSEVMVIHRMFIRLPDLSIAH---- :  49
IPD050Fl : AIPDYSNLYRELNQVSERMRMDQMEFSEVMVIHRMFFKLPDLDIAH---- :  49
IPD050Fn : AIPDYSHLYRELNQVSERIRMDQMEFSEVMVIHRMFIKFPDLGIAH---- :  49
IPD050Ft : AAREYSELYKDLNQISERIRLDQMEFSEVMVIHRMFIRLEELDLGH---- :  49
IPD050Fh : AGADWRELYSEMNQVSERLRLDQLEFSEVMIIHRMHIKLSELDLGH---- :  53
IPD050Fg : GIVDWRELYRDMNQASDRIRFNQLEFSEVMVIYRMHIKMSELDMGH---- :  53
IPD050Fm : AADAWREVYRDLNQVSDRIRLDQLEFSEVMIHRMHIKMSELDLGH---- :  59
IPD050Fd : ANEAWREVYHDLNQVSDRIRLDQLEFSEVMVVHRMHIKMSELDLGH---- :  54
IPD050Fr : AADGWREVYRGLNQVSDRIRFDQLEFSEVMVIHRMHIKMSELDLGH---- :  53
IPD050Bb : ADIDYSVLYNDVNQIS--IRLERMDFSEVMAVHRMFVRMDDLDVSSGTG- :  48
IPD050Bd : AGIDYSVLYQDVNQIS--IRLEKMDFSEVMAVHRMFVRMDDLDVSSGTG- :  48
IPD050Aa : AAGDYSVLYQDVNQIS--IRLEKMDFSEVMAVHRMFVRMDDLDVSSGTG- :  48
IPD050Ba : ADLDYSKLYQDLNQIS--VRLEKTEFSEVMVVHRMFVRMDDLDVSSGSG- :  48
IPD050Bc : ADVDYSKLYHDLNQIS--IRLGNVEFSEVMVVHRMFVRLDDLDVSSGSG- :  48
IPD050Fa : --MEYSALYGDVNQVS--LRFEKTEFSEVVVVHRMHVRLAELNVTLGDNN :  46
IPD050Ff : --MEYSSLYGDVNQVS--LRFQNMEFSEVMVVHRMHVRLEELDMTG---- :  42
IPD050Fq : -----------VNQVS--LRFQNMEFSEVMVVHRMHVRLEELDMTG---- :  33
IPD050Fi : --MEYSDLYHDVNMLS--LPLHRTELSEVMVVHRMHVKLRDLNLET---- :  42
IPD050Fj : --MEYSDLYADVNQVS--LRFQQTEFSEVMVVHRMYVRLLDLDMTTEPHL :  46
IPD050Fp : SLPDYYEIYKNVNQVS--RPVASRQASEVTSIHRMYFKLNLLEVAL---- :  46
IPD050Gd : VPEDYEAIYAGSNSITREVGVNKVRCGELMAIHQMFFRLDTLSQEL---- :  83
IPD050Ga : VVEDYEEIYRGSNSIAREVGVSKVNCGEVMAIHRMFFRLDTLSQEL---- :  82
IPD050Gb : LELDYEKIYAGSNSIAREVGLDKVNCGEVMAIHQMFFRLDTLSQEL---- :  81
IPD050Gc : LELDYERIYAGSNSIAREVGLNKVICGEVMAIHRMFFRLDTLSQEL---- :  82
IPD050Fb : CCCCCHHHHHHHHHHHHCCCCCCCCCCHHHHHHHHHHHHHHCCCCCCC-- :  49
IPD050Fs : CCCCCHHHHHHHHHHHHHCCCCCCHHHHHHHHHHHHHCCCCHHHHH---- :  49
IPD050Fo : CCCCCHHHHHHHHHHHHHCCCCCCCHHHHHHHHHHHCCCCCHHHHH---- :  92
IPD050Fk : CCCCCHHHHHHHHHHHHHCCCCCCCHHHHHHHHHHCCCCCCCCCC----- :  96
IPD050Fe : CCCCCHHHHHHHHHHHHHCCCCCHHHHHHHHHHHHCCCCCCCCC------ :  49
IPD050Fl : CCCCCHHHHHHHHHHHHHCCCCCHHHHHHHHHHHCCCCCCCCC------- :  49
IPD050Fn : CCCCCHHHHHHHHHHHHHCCCCCHHHHHHHHHHHCCCCCCCCC------- :  49
IPD050Ft : HHHHHHHHHHHHHHHHHCCCCCCHHHHHHHHHHHHHCCCCCC-------- :  49
IPD050Fh : CCCCHHHHHHHHHHHHHCCCCCCHHHHHHHHCCCCCCCCCCC-------- :  53
IPD050Fg : CCCCHHHHHHHHHHCCCCCCCCCCCCHHHHHHHCCCCCCCCCC------- :  53
IPD050Fm : HHHHHHHHHHHHHHCCCCCCCCCCCCHHHHCCCCCCCCCCCC-------- :  59
IPD050Fd : CHHHHHHHHHHHHCCCCCCCCCCCHHHHHCCCCCCCCCCCC--------- :  54
IPD050Fr : CCCCHHHHHHCCCCCCCCCCCCCCCHHHHHCCCCCCCCCCCC-------- :  53
IPD050Bb : CCCCHHHHHHHHHHCC--CCCCCCCCCCCHHHHHCCCCCCCCCC------ :  48
IPD050Bd : CCCCHHHHHHHHCCCC--CHHHHCCCHHHHHHHHHCCCCCCCCCC----- :  48
IPD050Aa : CCCCHHHHHHHHHCCCC--CCCCCCCCCCHHHHHHCCHHCCCCCC----- :  48
IPD050Ba : CCCCHHHHHHHHHCCCC--CCCCCCCCCCHHHHHHCCCCCCCCCC----- :  48
IPD050Bc : CCCCHHHHHHHHHHHHCC--CCCCCCCCCHHHHHHCCCCCCCCCC----- :  48
IPD050Fa : --CCCCCCCCCCCHH--HHCCCCCHHHHHHHEECCCCCEECCCCC----- :  46
IPD050Ff : --CCCCCCCCCCCH---CCCCCCHHHHHCCCCCCCCCCCC---------- :  42
IPD050Fq : -----------CCCCC--HHCCCCCHHHHHCCCCCCCCCCCC-------- :  33
IPD050Fi : --CCCCCCCCCCCCC---CCCCCCCCHHHHHCCCCCCCCCCC-------- :  42
IPD050Fj : --CCCCCCCCCCCHH--HHHCCCCCCHHHHHHHHHCCCCCHHHH------ :  46
IPD050Fp : CCCHHHHHHHHHCCCC--CCCCCCCCCHHHHHHHHHHHHHHH-------- :  46
IPD050Gd : CCCHHHHHHCCCCCEEECCCCCCCCCHHHHHHHHHHHHHHHHH------- :  83
IPD050Ga : CHHHHHHHHHCCCCHHHHCCCCCCCHHHHHHHHHHHCCHHHHHH------ :  82
IPD050Gb : CCCCHHHHHCCCCHHHHHHCCCCCCCHHHHHHHHHHCCCHHHHH------ :  81
IPD050Gc : CCCCHHHHHCCCCHHHHHCCCCCHHHHHHHHHHHHHCCHHHHHH------ :  82
```

Fig. 16c

```
         [----- motif 16 ------]      [--- motif 18 ---]
                          *      120          *      140          *
IPD050Fb : --REGAEQVKRLYVFADVVELSGTS--------LTTLLPGTMMVVILCRV :  89
IPD050Fs : --QEGAQQVKRLYVFADVVELPETSTSASA-EPVTLRLPGTVMVVILCRV :  96
IPD050Fo : --QEGAQQVKRLYVFADVVELPEMSTSVTVSETVTLRLPGTVIVVILCRV : 140
IPD050Fk : --LEGAGQVKRLYIFADVVELGGHL--------VTTQLPGTVMVVILCRV : 136
IPD050Fe : --LDGADKVKRLYVFADVVELGSVQ--------QTSSLPGSIMVVIMCRV :  89
IPD050Fl : --LDGADKVKCLYVFADVVELGSAG--------QTSNLPGSIMVVIMCRV :  89
IPD050Fn : --LEGADKVKCLYVFADVVELGSVR--------QTSSLPGSIMVVIMCRV :  89
IPD050Ft : --LEGAERVKRLYVFADVVEVEEGGNFIETG--PLARLPGSIMVVILCRV :  95
IPD050Fh : --LEGADKVKHLYVFADVVELDNAADPSTP---VDVRLPGSISVVFLCRV :  98
IPD050Fg : --LEGSEKVKRLYVFADVVEYDAN--------GIARLPGSISVVFLCRE :  92
IPD050Fm : --LEGAEKVERLYVFADVVELDVVPHESSSDGDVVVRLPGSKSVTFVCRV : 107
IPD050Fd : --LEGAEKVERLYVFADMVECDVPPHASSSDGDLVIRLPGSLSVIFICRV : 102
IPD050Fr : --LAGAEKVERLHVFADVVECDVPPHENSSDPDLVIRLPGSVSVTFMCRV : 101
IPD050Bb : -VLEGAQNVKRLYVFADVVELP----------SKQVRLPGSDMIVILCRI :  87
IPD050Bd : -LLAGAEKVKRLYVFADVVELP----------SKRVRLPGTDMIIILCRI :  87
IPD050Aa : -LLSGAEKVKRLYVFADVVELP----------SKQLRLPGTDLIVILCRI :  87
IPD050Ba : -LLSGAEKVKRLYVFADVVELP----------SKQVRLAGTDMIVVFCRI :  87
IPD050Bc : -LLSGAEKVKRLYVFADVVELP----------SKQVRLAGTDMIVVFCRI :  87
IPD050Fa : ILLQGSDRVKRLYVLADVVELPP-------IFSTSMSLPGTVSVVILCRI :  89
IPD050Ff : --LEGIEKVKRLYVLADVVELPSTA----TQVFQYLRLPASISAIILCRV :  86
IPD050Fq : --VEGIEKVKHLYVLADVVELPPKA----TSVFEYVRLPATISAIILCRV :  77
IPD050Fi : ---AVSDKVHRLYVVADVVEV----------TLDTVSLPCKVSVVILCRV :  79
IPD050Fj : QMLAGSEKVRRLYVVADVVELP--------ATATNMRLPATASVVILCRV :  88
IPD050Fp : --LTKADEVKELVVFADVVEMEG---------GKVELPASRIVTIVCRI :  84
IPD050Gd : --LQQPQLVKHLIVVADVVEIEGSR--------GTLVLPGSSLVLIFCRI : 123
IPD050Ga : --LRQPERVQRLIVVADVVEIEGSN--------DTLSLPGSSLVLVLCRI : 122
IPD050Gb : --LRRPELVKRLIVVADVVEIEGSN--------ATLSLPGSSLVLIFCRI : 121
IPD050Gc : --LRQPELVKRLVVVADVVEIEGAN--------ATLSLPGSSLVLIFCRI : 122
IPD050Fb : --HHHHHHHHHHHHHHCCCCC--------CCCCCCCCHHHHHHHH :  89
IPD050Fs : --HHHHHHHHHHHHHHCCCCCCCCCCCC-CCHHHCCCHHHHHHHH :  96
IPD050Fo : --HHHHHHHHHHHHHHCCCCCCCCCHHHHHHHECCHHHHHHHHH : 140
IPD050Fk : --CCCCCCCHHHHHHHHHHCCCHHH--------HHCCCCHHHHHHHH : 136
IPD050Fe : --CCCCCCCHHHHHHHHHHCCCCC--------CCCCCCCCHHHHHHH :  89
IPD050Fl : --CCCCCCCHHHHHHHHHHHHHCCCCC--------CCCCCCCCHHHHHHH :  89
IPD050Fn : --CCCCCCCHHHHHHHHHHCCCCC--------CCCCCCCCHHHHHH :  89
IPD050Ft : --CHHHHHHHHHHHHHCCCCCCCCCC--CCCCCCCCHHHHHHHH :  95
IPD050Fh : --CCCCCCCCHHHHHHHHHCCCCCCCCCC---CCCCCCCCHHHHHHHH :  98
IPD050Fg : --CCCCCCCHHHHHHHHHCCC---------CCCCCCCCHHHHHHHHC :  92
IPD050Fm : --CCHHHHHHHHHHHHHCCCCCCCCCCCCCCCCCCCHHHHHHHH : 107
IPD050Fd : --CCHHHHHHHHHHHHHHHCCCCCCCCCCCCCCCCCCCCCHHHHHHHH : 102
IPD050Fr : --CCCCHHHHHHHHHHHHHCCCCCCCCCCCCCCCCCCCCHHHHHHHH : 101
IPD050Bb : -CCCCCCCCHHHHHHHHHHHCC----------CCCCCCCCCCHHHHHH :  87
IPD050Bd : -CCCCCCCCHHHHHHHHHHHC-----------CCCCCCCCCCHHHHHH :  87
IPD050Aa : -CCCCCCCCHHHHHHHHHHHCC----------CCCCCCCCCCHHHHHH :  87
IPD050Ba : -CCCCCCCCHHHHHHHHHHHC-----------CCCCCCCCCCHHHHHH :  87
IPD050Bc : -CCCCCCCCHHHHHHHHHHHC-----------CCCHCCCCCCHHHHHH :  87
IPD050Fa : CCCCCCCCCHHHHHHHHHHHCCCCC-------CCCCCCCCCCCCHHHHHH :  89
IPD050Ff : --CHHHHHHHHHHHHHHCCCCCCCCHH----HHHHHHHCCCCCHHHHHHHH :  86
IPD050Fq : --CCCCHHHCHHHHHHHCCCCCCCC----CCCEHHHCCCCCHHHHHHHH :  77
IPD050Fi : ---CCCCCCHHHHHHHHHH----------HHHHCCCCCCCCHHHHHHHH :  79
IPD050Fj : HHHCCCCCHHHHHHHHHHHCC--------CCCCCCCCCCCCHHHHHHHH :  88
IPD050Fp : --HCCCCCCHHHHHHHHHHHCC----------CHHCCCCCHHHHHHH :  84
IPD050Gd : --HCCCCCCCHHHHHHHHHHCCCC--------CHHHCCCCCHHHHHHHH : 123
IPD050Ga : --HCCCCCCHHHHHHHHHCCCC--------CCCCCCCCCHHHHHHHH : 122
IPD050Gb : --HCCHHHHHHHHHHHHHHCCCC--------CHHHCCCCCCHHHHHHH : 121
IPD050Gc : --HCCHHHHHHHHHHHHHHCCCC--------CHHHCCCCCHHHHHHHH : 122
```

Fig. 16d

```
                    160         *         180         *         200
IPD050Fb : LSVRSF---------------QSQHGLDFPHMRLHAV-PGDNQMLRIHR : 122
IPD050Fs : LLFQGS---------------YSAYDLDFPHMRLHAV-PGEAQILRIHR : 129
IPD050Fo : LFYQG----------------FARYDLDFPHMRLHAVQPSGAGVLRMHR : 173
IPD050Fk : LSLRSP---------------TARYGLNFPHMRLHAVFQSASRILHMHR : 170
IPD050Fe : LTLHVDPI-------------ATAYQCDFPHMRLHAFFGSNG--VRIDR : 123
IPD050Fl : LTLHADWS-------------RTSYRFVFPHMRLHAIFDLQQ--ARIHR : 123
IPD050Fn : LTLHLDSA-------------AQAYRIDLPHMRLHAINDAQR--LRIHR : 123
IPD050Ft : LSVRVLMF----------DNGNNAMRLQLPHMKLRVVEITTQPTTKLQI : 134
IPD050Fh : WHVSRRLTVGVNSPQYWLPTFDGRPVRIQLPHVKWHMNTLTRS----MHR : 144
IPD050Fg : WHVSYHLVARMDRNPPRYQLDLAQGVIISLPHMAWHLDVRRQS----MHR : 138
IPD050Fm : WHINYALVQISS------FARISRSVVLELRHMRWHFNAITGR----MHL : 147
IPD050Fd : WHINVGVVQLTS------TVQMSRTLIVQLPHMRWHVNATTGS----MHR : 142
IPD050Fr : WHVNYGIVQRTS------TVRVARTVVVQLPHMRLHFNATTGS----MHR : 141
IPD050Bb : FVRNGRHNTEL----------------FLPSMNMSMVAA-GNGTIRGVN : 119
IPD050Bd : FVVNGRHSTEL----------------FLPSMNLNMVAA-GTGSIRGAY : 119
IPD050Aa : FVTNGRHSTEL----------------FLPSMNMSMVAP-GTGSIRGVI : 119
IPD050Ba : FVPEGRHYAEL----------------FLPSMNMSMVGADGEGSIRGVI : 120
IPD050Bc : FVINGHHGTEL----------------FLPSTSMSMVAA-GEGSIRGVI : 119
IPD050Fa : LYLPYLEDASS-----------ASGWAVHAALLRLRVVEMHAG-FAQVFT : 127
IPD050Ff : LYIPEVDQRP-----------HMAQCSLDFPFMRLHVVGSAHENGGGVMQ : 125
IPD050Fq : LYIPEVQRLSGAG--------FRGQCSLDFPFMRLHVVGAAHESGGGVMQ : 119
IPD050Fi : LHVE--QSSVL-------------FSSLLLPNMNVRVVLSNN--RMQVYP : 112
IPD050Fj : LYVQDVNSPYL-------------ACGLHFPLMPLRVVEDTQQGRVHVFP : 125
IPD050Fp : LSLKRED--------------------VELGFKFLGPVECEEGWQVGLNS : 114
IPD050Gd : LVLKSKD--------------------VVLDLGSWDLSVATTSSPLVRCSIR : 155
IPD050Ga : LILKSKD--------------------VVLDLTSWDLTVATTT-PLHRCSIH : 153
IPD050Gb : LILKSRN--------------------LVLDLDNWNLRAASTT-PLHRCSIR : 152
IPD050Gc : LILKSRD--------------------VVLDLSNWDLRVATTT-PLHRCSIR : 153
IPD050Fb : HCCCCC---------------CCCCCCCCCCCCCCCC-CCCCCCEEECC : 122
IPD050Fs : HHCCCC---------------CCCCCCCCCCCCCCCC-CCCCHHHHCC : 129
IPD050Fo : HHHCC----------------CCCCCCCCCCCEEEECCCCCCCEEEEEC : 173
IPD050Fk : HCCCCC---------------CCCCCCCCCCHHHHHHHHHHHHHHHCC : 170
IPD050Fe : EECCCCCC-------------CCCCCCCCCCCCHHCCCCCC--EEECC : 123
IPD050Fl : HCCCCCCC-------------CCCEEEECCCCCHHHHCCHHH--HHHHC : 123
IPD050Fn : HHHCCCHH-------------HHHHHCCCCCCCCCCCCCCH--HHHCC : 123
IPD050Ft : EEEEEEEE----------ECCCCCEECCCCCCCCEEEEECCCCCCEEE : 134
IPD050Fh : EEECCEEEECCCCCCCCCCCCCCCCCEEEECCCCHHHHHHHHH----HCC : 144
IPD050Fg : CCHHHHHHCCCCCCCCCCCCCCCCCEEEECCCCCHHCCCC----CCC : 138
IPD050Fm : EEECHHHHCCH------HHHHHHHHHHHCCCCCCCCCCCC----CCC : 147
IPD050Fd : EEEEEEEEEEE------EEEECCEEEECCCCEECCCCCC----CCC : 142
IPD050Fr : EEEEEEEEEEE------EEEEEEEEEECCCEEEEECCCCC----CCC : 141
IPD050Bb : HHHCCCCCCCC----------------CCCCCCCCEEEC-CCCCCCCCC : 119
IPD050Bd : EEEECCCCCCC----------------CCCCCCCCCCCC-CCCCCCCCC : 119
IPD050Aa : HHCCCCCCCCC----------------CCCCCCCCCCCC-CCCCCCCCC : 119
IPD050Ba : EEEECCCCCCC----------------CCCCCCCCCCCCCCCCCCCCCC : 120
IPD050Bc : EEEECCCCCCC----------------CCCCCCEEEEEC-CCCCEEEEE : 119
IPD050Fa : EECCCCCCCCC-----------CCCHHHHHHHHHHHHHCCC-CEEEEE : 127
IPD050Ff : HCCCCCCCCC-----------CCCCCCCCCCEEEEECCCCCCCCCCCCE : 125
IPD050Fq : HCCCCCCCCCCCC--------CCCCCCCCCEEEEEECCCCCCCCCCCCE : 119
IPD050Fi : EEEE--CCHHH-------------HHCCCCCCCEEEEEECC--CEEEEE : 112
IPD050Fj : EEEECCCCCCC-------------CCCCCCCCCEEEECCCCCCEEEEEE : 125
IPD050Fp : HCCCCCC--------------------CCCCEECCCCCCCCCCCCCCCC : 114
IPD050Gd : HEECCCC--------------------EEEECCCCCCCCCCCCCEEEEEC : 155
IPD050Ga : EEEECCC--------------------EEEECCCCCEEECC-CCCCCEE : 153
IPD050Gb : HHHCCCC--------------------CCCCCCCCCCCCCCC-CCCCCCC : 152
IPD050Gc : HHCCCCC--------------------EEEECCCCCCCCCC-CCCCCCC : 153
```

Fig. 16e

```
                     *         220         *         240         *
IPD050Fb : RNPDSAQYDDYPVVCVHADVLEFPVTG---------GRDIFHLGPLANPC : 163
IPD050Fs : RNPDSAQYDDYPVVCVHADVLEFPVTG---------GRDIFHLGPLANPC : 170
IPD050Fo : LNPDSVQYDDYPVVCVLADVVEFTRQR---------PSRLFRIGPLAYPS : 214
IPD050Fk : LIPDSAQYDAYPVVCVHADALEFSGTS---------TGGIFHIGPLRYPS : 211
IPD050Fe : RNSDSVH-DDYPVITVSANVIEFSGTR---------AETLFAIAPLRDPS : 163
IPD050Fl : RNSDSVH-DDYPVITISANVIEFSGTRS--------SSVLFGIGVFLDPS : 164
IPD050Fn : RNSDSLH-DDYPVITISANVIEFSGTRS--------LRDIFGIGPLQDPS : 164
IPD050Ft : HRADAED-YQYPALCIHADVIQASIRLSSSSNRPPMDLRFFNFRPNRGSD : 183
IPD050Fh : IDPETLQDLSGPLLCVYADLLRTSLHPPVGHSNWDAALAFPSMTVLREVE : 194
IPD050Fg : LDPETLQEFLEPSFCVYADDISVAYYSLNGAS-WDPALQFPDTAELAKCA : 187
IPD050Fm : LDPQTLQDGMDLCFCVHAEVVQIAYY---------PDVTFPESNDSPSFL : 188
IPD050Fd : LHPQTSQEGPDTSFCVYAEVVQVAYY---------PDVTFSEFDGSPT-L : 182
IPD050Fr : LHPQTSQDGSDTCFCVYAEVVQIAYY---------PDVTYPESNDSPVGL : 182
IPD050Bb : LS-TTMSSSSSNALQFNLRSGSMTS--------------TVRLKDVDVAA : 154
IPD050Bd : LS-TTAFSLSSNALQFKLQSGSMTS--------------AIQLKDVDLAA : 154
IPD050Aa : LSPTTVLTTSSDALQFKLQSGSMTS--------------VMRLKDVSVAA : 155
IPD050Ba : LS-PTVLTTLSNALQFRLECGSMTS--------------VMRLNDVSAGA : 155
IPD050Bc : LS-PTTLTPLSHALQFKLESGSMTS--------------VMRLNDVSVAA : 154
IPD050Fa : IPANDSSAAAPADIGLYIHADRIIYRDDPGRS-----IPVIEVRVGG-DS : 171
IPD050Ff : AFSSD---ATPSNIGIYFHADRFIYRQATSSASN--FVLPLDVRVSFGSS : 170
IPD050Fq : AFSSD---ATAGNIGVYLHADRFIYREAASPASD--FVWPLDVRVSFGSS : 164
IPD050Fi : MATDG----SADDVALYIHADRVIRRQGAWTL-----VRVMHMSITGPES : 153
IPD050Fj : VVGGES--ASVDKIGLYIHADRVVYRQDTSTAN---PLQPLQLRVIGNGS : 170
IPD050Fp : EMAYIRRTSPQVRLSIYAQEVVHNSTG-----------AILRVTHPVTVR : 153
IPD050Gd : AQQVVISSG-SLSASLLIQAKHRLRWSDGSHLDQYFGRPFSFASSKINSF : 204
IPD050Ga : AQRVVVASG-SLSASLLIQVKHKFEWSDGTHLDQYFGRPFSFIASEINSS : 202
IPD050Gb : AQRVVIASGFSLYSSLLIQVKHKFEWSDGTHLDQYFGRPFYFTAIGINSS : 202
IPD050Gc : AQRVVVASG-SLSASLLIQVKHKFEWSDGTHLDQYFRRPISFTASRINSS : 202
IPD050Fb : CCCCCCCCCCCCEEEEEEEEEECCCC---------CCCCCCCCCCCCCE : 163
IPD050Fs : CCCCCCCCCCCCEEEEEECCCCCCCC---------CCCCCCCCCCCCCE : 170
IPD050Fo : CCCCCCCCCCCCEEEEEEHHHHHCCC---------CCCCEECCCCCCCC : 214
IPD050Fk : CCCCCCCCCCCCEEEEECCEEECCCC---------CCCEECCCCCCCCC : 211
IPD050Fe : CCCCCCC-CCCCEEEEEEEEEECCCC---------CCEEEECCCCCCCC : 163
IPD050Fl : CCCCCCC-CCCCEEEEEECEEECCCCCE--------EEEECCCCEECCCC : 164
IPD050Fn : CCCCCCC-CCCCEEEEEEEEEECCCCC--------CCCCCCCCCCCCCC : 164
IPD050Ft : ECCCCCC-CCCCHHHHHHHHHHCCCCCCCCCCCCEEECCCCCCCCCC : 183
IPD050Fh : CCCCCCCCCCCCHHHHHHHHHCCCCCCCCCCCCCCCCCCCCCCCEECC : 194
IPD050Fg : CCHHHHHHHHCCCCEEEECCEEEEEEECCCCC-CCCCCCCCHHHHHHHE : 187
IPD050Fm : CCCCCCCCCCCCEEEEEEEEEEEECC---------CCCCCCCCCCCCCC : 188
IPD050Fd : CCCCCCCCCCCCEEEEEEEHHCCC---------CCCCCCCCCCCC-E : 182
IPD050Fr : CCCCCCCCCCCCEEEEEEHHHHCC---------CCCCCCCCCCCCEE : 182
IPD050Bb : CC-EECCCCCCCEEEEEECCCCC--------------EEEEEECCCCC : 154
IPD050Bd : CC-EEECCCCCCCCCEECCCCCC--------------CEECCCCCCCC : 154
IPD050Aa : CCCCEEECCCCCCCCCCCCCEEE--------------EEEEECCCCCC : 155
IPD050Ba : CC-CCHHCCCCCCCCEEEECCEEE-------------EEEECCCCCCC : 155
IPD050Bc : EE-CCCCCCCCCEEEEEECCCCCEE-------------EEECCCCCCC : 154
IPD050Fa : EECCCCCCCCCCCCCEEEEEEEEECCCCCC-----CCCEEEEECC-CC : 171
IPD050Ff : ECCCC---CCCCCEEEEECCHHHHHCCCCCCC--CEEEEEEEEECCC : 170
IPD050Fq : ECCCC---CCCCEEEEEECCHHHHHCCCCCCC--CCCCCEEEEECCC : 164
IPD050Fi : CCCCC----CCCCEEEEEEECHHHHCCCCEE-----EEECCCCCCCCC : 153
IPD050Fj : ECCCCC--CCCCEEEEEEECEEEEECCCCCCC---CCCCCEEEEECCC : 170
IPD050Fp : CHHHHHHCCCCCEEEEEEECCCCCCCE-----------EEEEECCCEE : 153
IPD050Gd : CCHHHHHCC-CCHHHHHHHHHHHHCCCCCCCCCCCCCCCCCCCCCEEEE : 204
IPD050Ga : EEEEEEECC-CCEEEEEEHHCCCCCCCCCCCCCCCCEEEEECCCCC : 202
IPD050Gb : CCEEEEECHHHHHHHHHHHHCCCCCCCCCCCCCCCCCCEEEEECCC : 202
IPD050Gc : CCEEEEEEC-CCCCHHHHHHHHCCEECCCCCCCCCCCCCCCCCCCC : 202
```

Fig. 16f

```
                 260         *        280         *        300
IPD050Fb : MVIT--FPPQS--LEEAPVS---------------SFTGSVRLWTAAASS : 194
IPD050Fs : MVVT--HPQLS--LVEAPVS---------------SFTGSVRLWSAATSS : 201
IPD050Fo : MIFTDERPPASSIVEPRPVS---------------SFYCTIEFR---WSS : 246
IPD050Fk : MIVT----SESHSAVDAQIS---------------SFSCNVSLRSASASS : 242
IPD050Fe : MIIS---SDLISNTVERPAS---------------GFFCNVVPNWG-QPS : 194
IPD050Fl : MVLS----SDRHSIVERPSS---------------HTLCNVNPVE--QSS : 193
IPD050Fn : MIITN--TETQPPVVERPSI---------------NSLCTVGLVQGQSSS : 197
IPD050Ft : NVVFS---SESRSLIDEPVE---------------IFYVYSHIPRFIHAL : 215
IPD050Fh : VLPCFDHSTPRQG-LLTLTSNAAPQWVN--QLRAAFIFTDQDAMTEILSL : 241
IPD050Fg : LLIYSNSNPTPNHVLLTSNRFNGTRWAFRFEFSMYY-IDNEDVAKDIALQ : 236
IPD050Fm : RFLRLEIVPDQ---LRVTTQTDGPVWALRGALEYFMAPDNDGLLNEVSSQ : 235
IPD050Fd : RFLRLEFESDQ---LRVTTQTEGPIWAIRASLDTTMTPDNDGLLNEISAQ : 229
IPD050Fr : RFLRLEFGSDQ---LRVTRQSEGPVWALRGSLNYSMSPDNDGLMNEVSSQ : 229
IPD050Bb : ALTC--------DVQAASAS-------------MPLTVMTTG---TSPGN : 180
IPD050Bd : TLTC--------DVQAASAS-------------MPIVVKTTG---TSPGN : 180
IPD050Aa : TLTC--------NVQAASAS-------------MPLTVKTTG---TSPGN : 181
IPD050Ba : TLTC--------NVQAASAC-------------VPLKVKTTG---TSPGN : 181
IPD050Bc : TLAC--------NVQAASAS-------------MPLKVKTTG---TSPGN : 180
IPD050Fa : RFSP--FLPGSPEIRLSSVQ-------------YVR-EFSKGQPVAPEDS : 205
IPD050Ff : TFSAPTLRPDWQNLNVSNIQ-------------YGPQHLSRGPPLTSSDS : 207
IPD050Fq : TFSN-TAVPDWQNLNVSSIR-------------YDSQRLSKGPPLTSSDS : 200
IPD050Fi : TFS----VPHLPDPALFNRV-------------MVNVQMDAGPSIPASES : 186
IPD050Fj : TFST-EVRPDWPKTLEVSSL-------------LMWLTLSKGQPIPAAES : 206
IPD050Fp : QRVS---------PHRPSQ---------------YTPGTMKWQINISSA : 178
IPD050Gd : ATTTTQTSYAKQSISTWPGVPP-----------TSNLIVVNSETFNVRVN : 243
IPD050Ga : ATATTRTNSAMRSISTWPGTAP-----------VSNFIRVNSEKFNVLVN : 241
IPD050Gb : ATITTTATSAMRSINTWPGTAP-----------VSNFIRVNSEKFNVLVN : 241
IPD050Gc : AAITTRTTSATRSINTWPGTAP-----------VSNFIQVNSEKFNVLVN : 241
IPD050Fb : EEEE--ECCCC--CCCCCCC---------------CCCCCEEEEEEECCC : 194
IPD050Fs : EEEE--CCCCC--CCCCCCC---------------CCCCCEEEECCCCC : 201
IPD050Fo : CCCCCCCCCCCCCCCCCCCC---------------CCCEEEEEE---EEC : 246
IPD050Fk : CCCC----CCCCCCCCCCCC---------------CEEEEEEECCCCCCC : 242
IPD050Fe : CEEE---CCCCCCCCCCCCC---------------CCCCCCCCCCC-CCC : 194
IPD050Fl : CEEE----ECCCCCEECCCC---------------CCEEEECCCC--CCC : 193
IPD050Fn : EEEEE--CCCCCCEECCCCC---------------CCCEEEEEEECCCCC : 197
IPD050Ft : CEEEC---CCCCCCCCCCEE---------------EEEEEECCCCCCCCC : 215
IPD050Fh : EECCCCCCCCCCC-CEEEECCCCHHHHH--HHCCEEEEECCCCCCCCCCC : 241
IPD050Fg : EEEEECCCCCCCCEEEECCCCCCEEEEEEEEEE-ECCCCHHHHCCCC : 236
IPD050Fm : CEEEEECCCCE---EEEEECCCCHHHHCCCCCCCCCCCCCCCCCCCCC : 235
IPD050Fd : EEEEEEEEEEE---EEEEECCCCHHHHCCCCCCCCCCCCCCCCEECCC : 229
IPD050Fr : EEEEEEECCCC---EEEECCCCCCCCCCEEEEECCCCCCCCCCCCCCC : 229
IPD050Bb : CCCC--------EEECCCCC-------------CCEEEECCC---CCCCC : 180
IPD050Bd : CCCC--------CCCCCCCC-------------CCCEECCCC---CCCCC : 180
IPD050Aa : CEEE--------EEECCCCC-------------CCCCCCCCC---CCCCC : 181
IPD050Ba : EEEE--------EECCCCCC-------------CCCCCCCCC---CCCCC : 181
IPD050Bc : CCCC--------CCCCCCCC-------------CCCCCCCCC---CCCCC : 180
IPD050Fa : CCCC--CCCCCCCCCCCCHH-------------HHH-HHCCCCCCCCCCC : 205
IPD050Ff : CCCCCCCCCCCCCCCCCCCC-------------CCCCCCCCCCCCCCCCC : 207
IPD050Fq : CCCC-CCCCCCCCCCCCCEE-------------ECCCCCCCCCCCCCCCC : 200
IPD050Fi : CCC----CCCCCCCCCCCCC-------------EEEEECCCCCCCCCCCC : 186
IPD050Fj : CCCC-CCCCCCCCHHHHHH-----------HHHHHHCCCCCCCCCCC : 206
IPD050Fp : EEEC---------CCCCCC---------------CCCCCEEEEEEECC : 178
IPD050Gd : EECCCCCCCCCCCCCCCCCCCC-----------CCCCCCCCCCCCCCEEC : 243
IPD050Ga : CEEECCCCCCCEEEECCCCCC-----------CCEEEEECCCCEEEEEC : 241
IPD050Gb : CEEEEEECCCCCCCCCCCCCC-----------CCCCEECCCCCCCCCCC : 241
IPD050Gc : CCEEECCCCCEEEECCCCCCC-----------CCCCCCCCCCCCCCCCC : 241
```

Fig. 16g

```
                        *         320         *         340         *
IPD050Fb : PH----RIDPNNLTFT----PGFMVQQGGSFNLPFNTQSE-----DFWLL : 231
IPD050Fs : PH----SIDPNNLTFT----PSFSVQGGGSFNLSFATRSE-----DFWLL : 238
IPD050Fo : SN----NIGPNSVGIG----CVFRLSGGSTFST--GSPRE-----DFWLF : 281
IPD050Fk : PL----KINPDNVSFQ----SMFNLVTGGGFGF--AVRPE-----EFWLL : 277
IPD050Fe : PI----TVDPLRIRFQ----TGATMVGGGSLT--FPLGPE-----GFSIL : 229
IPD050Fl : PI----MVDPDTIRFQ----SIFNWVGSNIMSPQVARAPE-----GFSLF : 230
IPD050Fn : PV----TVDPDRISRH----FWFQSVGGGALG--TLRAAE-----GFSLF : 232
IPD050Ft : PIPEAATVDPASRSND----WYYVSLRRVNSTLSSSVAAEGELEPAFSLL : 261
IPD050Fh : PADASVILNKNRPSII----LTAGQSGGYT--------DRNVSAPAFSVL : 279
IPD050Fg : PPGTRVIFKREGLHLV----VLAMDSANRIISFDPERGDLDAYMPAFSLL : 282
IPD050Fm : PAGTSFVLNILPDNLD----VQLFANLRPNSGTTLTR-DPNTIVPAFSVY : 280
IPD050Fd : PAGTIFKLNILPDNLI----VSLFGSLRPNSSTSLTR-VPDNLLPAFSIF : 274
IPD050Fr : PAGTSFILNILPDNLN----LQLMASLRRNSNSTLTR-DPDNIVPAFSVY : 274
IPD050Bb : IWVLGMTTAVVIPESA---------------------------------- : 196
IPD050Bd : ILVLGMSTAVVIPESA---------------------------------- : 196
IPD050Aa : ICVLGMSTAVVVPESA---------------------------------- : 197
IPD050Ba : ICVLGLSTAAVVPESV---------------------------------- : 197
IPD050Bc : ICVLGMSTDAVVPENV---------------------------------- : 196
IPD050Fa : ELQRSDEIELIAPSGS-------EQQLRAAFGASVGMNLLFHFSSSFDIL : 248
IPD050Ff : DLQRSDEIELLAQQDVWSPLLHVAFSPNAPPGNIPGTQGIFRPSSACSFF : 257
IPD050Fq : DLQRSDEIELLAQQDIWSPILHVSFNPNAPPGNVPGTQGLFRPSSACSFF : 250
IPD050Fi : DLQRSDETELVSRVSN---GVTVSASIAGSAWTMPADNP----SATFTVF : 229
IPD050Fj : DLQRHDEVELLSPPSPDRLSVVFAYLAPGNLFSIAVDVEYI--GAGFCYF : 254
IPD050Fp : HADLSTAQRSHELRTQR-----FWSEPERTWLINPQEWSP------FTFF : 217
IPD050Gd : AVPWKGVVDCQTALPS---------------------------------- : 259
IPD050Ga : AVPWKGVVDCQASLPS---------------------------------- : 257
IPD050Gb : AVPWKGVIDCQAALPS---------------------------------- : 257
IPD050Gc : AVPWKGVVDCQAALPS---------------------------------- : 257

IPD050Fb : CC----CCCCCCCCCC----CCEEECCCCCCCCCCCCCH-----HHHHH : 231
IPD050Fs : CE----EECCCCCCCC----CCCCCCCCEEEEEEEECC-----CCCHH : 238
IPD050Fo : CC----CCCCCCCCCE----EEEEECCEEEEE--CCCCC-----CCCEE : 281
IPD050Fk : CC----CCCCCCCCCC----CCEEEECCCEEE--EECCC-----CHHHH : 277
IPD050Fe : CC----CCCCCEEEEE----CCCCCCCCCCC--CCCCCC-----CCCCC : 229
IPD050Fl : CC----CCCCCCEEEC----CEEECCCCCCCCCCCCCC-----CCCCC : 230
IPD050Fn : CE----EECCCCCCCC----EEEEEECCCCE--EEECCC-----CCCCC : 232
IPD050Ft : CCCCCCCCCCCCCCCC----EEEEEEECCCEEECCCCCCCCCCCCCCCC : 261
IPD050Fh : CCCCCEEEECCCCEEE----EECCCCCCC--------CCCCCCCHHHHH : 279
IPD050Fg : CCCEEEEEECCCCEE----EEEECCCCEEEECCCCCCCCCCCCCCCCC : 282
IPD050Fm : CCCCEEEEEECCCCC----CEEEEECCCCCEEEC-CCCCCCCCCHHH : 280
IPD050Fd : CCCCEEEEEECCCCC----EEECCCCCCCEEEE-CCCCCCCHHHH : 274
IPD050Fr : CCCCEEEEEECCCCC----CCCCCCCCCCCCCC-CCCCCCCCHHH : 274
IPD050Bb : CCCCCCCCCCCCCCCC---------------------------------- : 196
IPD050Bd : HHHHHCCCCCCCCCCC---------------------------------- : 196
IPD050Aa : CEEEECCEEEECCCCC---------------------------------- : 197
IPD050Ba : CCCCCCCCCCCCCCCH---------------------------------- : 197
IPD050Bc : CEEEECCCCCCCCCCC---------------------------------- : 196
IPD050Fa : CCCCCCEEEEECCCCC-------CHHHHHHCCCCCCCCCCCCCCCCCCC : 248
IPD050Ff : CCCCHHHHHHHHCCCCCCHCCCCCCCCCCCCCCCCCCCCCCCCCCCCCC : 257
IPD050Fq : CCCCHHHHHHHHCCCCCEEEECCCCCCCCCCCCCCCCCCCCCCCCCCCC : 250
IPD050Fi : CCCCCCCEEEEEECC---CEEEEEEECCCCCCCCCC----CCCCCCC : 229
IPD050Fj : CCCCCCCCCCCCCCCCEEEEEEEECCCCEEEEEEEEE--CCCEEEE : 254
IPD050Fp : CCCCCCCCCCCCCCEE-----EECCCCCEEECCCCCC------CEEC : 217
IPD050Gd : CCCCCEEEECCCCCCC---------------------------------- : 259
IPD050Ga : CCCCCEEEECCCCCCC---------------------------------- : 257
IPD050Gb : CCCCCCHHCCCCCCCC---------------------------------- : 257
IPD050Gc : CCCCCEEECCCCCCCC---------------------------------- : 257
```

Fig. 16h

```
           [---------- motif 14 ----------] [------
             360         *         380         *         400
IPD050Fb : RRN----LPDALLKDSSILLCMQTSMLIAELVE-FSHPSSDVRAAVTLHA : 276
IPD050Fs : QRN----LPDALLKDSSILLCMQTSMLIAELVE-FSHPSSDVRAAVTLHA : 283
IPD050Fo : RRD----LPDALFKDSSILPCMQTSMLVAELVE-FCHPSPDVRAAIRSHA : 326
IPD050Fk : RRD----LPDALLNDSSILLCMQTSMLVAELVE-FSHPSSDLHAAIILHA : 322
IPD050Fe : QRN----LPDLLLIDPNILLCMQTSMLVAELVE-FSHPSSDIHAAVTDHV : 274
IPD050Fl : RRD----LPDLLLIDPNILLCMQTSMLIAELVE-FSHPSSDIHAAVTEHL : 275
IPD050Fn : QRD----LPDVLLIDPNILLCMQTSMLVAELVE-FSHPSSDIHSAVTEHV : 277
IPD050Ft : KPK----IPVVVLTDPNILLAMQTSLLIAELVE-VAHPSAETADAVAKHV : 306
IPD050Fh : REGAE--TPIDSLTDPNFLPAMQTSMLIAELVE-VGRPSAAIIEVMHKHV : 326
IPD050Fg : RQDAK--FPIELLTDPNILSAMQTSMLIGELVE-VGNPSTAVTEVVHKHV : 329
IPD050Fm : KEK-----EGELLSDPNILPAMQTSMLIGELVE-VGQPPSVTTEVVRKHV : 324
IPD050Fd : REK-----AVELLTDPDVLSAMQTSMLIGELVE-VGQPPEATTEVVRKHI : 318
IPD050Fr : REKL----AVELLTDPNTLPPMQTSMLIGELVE-VGQPPEATIEVVRKHI : 319
IPD050Bb : ---------VAVITDANILLGMQVTVLIAELVK-TAHNSDVIIAAITRHV : 236
IPD050Bd : ---------VAVITDANILLGMQVTVLIAELVK-TAHNSDVVIAAVTRHV : 236
IPD050Aa : ---------VAVITDANILLGMQVTVLIAELVK-IAHNSDVLIAAVTRHV : 237
IPD050Ba : ---------VAVITDANILLGMQVTVLIAELVK-IAHNSDGVIAAVTRHV : 237
IPD050Bc : ---------KAVMVDVNILMGMKLTVLIAELVK-IANNSDAVIAAVTRHV : 236
IPD050Fa : S---LDPVPAALLTDPNIITGMQMNMLIAELVLTAAHNSPQLIKVVTRHV : 295
IPD050Ff : HVPPPD-VPANVLTDPSIILGMQMNMLIAELVL-AAHNSPQVMNVITKHV : 305
IPD050Fq : HVPPPD-VPANVLTDPSIILGMQMNMLIAELVL-AAHNSPQVMNVVTKHV : 298
IPD050Fi : PNPPAQPVARGVLTNPYVIIGLQMNMLTAELVQ-AAHNAPLLIRAVTRHV : 278
IPD050Fj : RIPPADPVPTEVLTDPYVIIGLQMNMLIAELVL-AAHNSPPVISVVTKHV : 303
IPD050Fp : LPPG--LLPLAILGDSNIMLGMQSTLLIAELVLSYQTHAQATVSAAHRHL : 265
IPD050Gd : ---------SDDLLHPHVISGIQSTLLIVETILNFQTSNPSIIVLAQQHA : 300
IPD050Ga : ---------LDDLLHPDVISGIQSTLLIVETILNFQTDNPAIIILAQQHA : 298
IPD050Gb : ---------LDDLLHPDVISGFQSTLLIVETILNFQTDNPAIISLARQHA : 298
IPD050Gc : ---------LDDLLHPDVISGIQSTLLIVETILNFQTDNPDIIVLARQHA : 298
IPD050Fb : HHH----CCCCCCCCHHHHHHHHHHHHHHHHH-HHCCCCHHHHHHHHH : 276
IPD050Fs : HCC----CCCCCCCCHHHHHHHHHHHHHHHHH-HHCCCCHHHHHHHHH : 322
IPD050Fk : HCC----CCCCCCCCHHHHHHHHHHHHHHHHH-HHCCCCHHHHHHHHH : 283
IPD050Fo : ECC----CCCCCCCCCCCCHHHHHHHHHHHHH-HHCCCHHHHHHHHHH : 326
IPD050Fe : CCC----CCCCCCCCHHHHHHHHHHHHHHHHH-HHCCCCHHHHHHHHH : 274
IPD050Fl : CCC----CCCCCCCCHHHHHHHHHHHHHHHHH-HHCCCHHHHHHHHHH : 275
IPD050Fn : CCC----CCCCCCCCHHHHHHHHHHHHHHHHH-HHCCCCHHHHHHHH : 277
IPD050Ft : CCC----CCCCCCCCHHHHHHHHHHHHHHHHH-HHCCCCHHHHHHHHH : 306
IPD050Fh : HHCCC--CCCCCCCCCCHHHHHHHHHHHHHHH-HCCCCHHHHHHHHHH : 326
IPD050Fg : CCCCC--CCCCCCCCHHHHHHHHHHHHHHHHH-HCCCCHHHHHHHHHH : 329
IPD050Fm : HCC-----CCCCCCCCCHHHHHHHHHHHHHHH-CCCCCCCHHHHHHHH : 324
IPD050Fd : HHH-----CCCCCCCCHHHHHHHHHHHHHHHH-CCCCHHHHHHHHHH : 318
IPD050Fr : HHHH----HHHHCCCCCCCCCHHHHHHHHHHH-CCCCHHHHHHHHHH : 319
IPD050Bb : ---------EEECCHHHHHHHHHHHHHHHHHH-HCCCCHHHHHHHHHH : 236
IPD050Bd : ---------CEEECCHHHHHHHHHHHHHHHHH-HHCCCHHHHHHHHHH : 236
IPD050Aa : ---------CCCCCCCCCCHHHHHHHHHHHHH-HHHCCHHHHHHHHHH : 237
IPD050Ba : ---------HHHHHCCCCHHHHHHHHHHHHHH-HHCCCCHHHHHHHHH : 237
IPD050Bc : ---------CCHHHHHHHHHHHHHHHHHHHHH-HHCCHHHHHHHHHHH : 236
IPD050Fa : C---CCCCCCCCCCCCCCHHHHHHHHHHHHHHCCCHHHHHHHHHHH : 295
IPD050Ff : CCCCCC-CCCCCCCCCHHHHHHHHHHHHHHHH-HHCCCCCHHHHHHH : 305
IPD050Fq : CCCCCC-CCCCCCCCCHHHHHHHHHHHHHHHH-HHCCCCCHHHHHHH : 298
IPD050Fi : CCCCCCCCCCCCCCCCHHHHHHHHHHHHHHHH-HHCCHHHHHHHHHH : 278
IPD050Fj : CCCCCCCCCCCCCCCCCHHHCCHHHHHHHHHHH-HCCCCCCHHHHHHH : 303
IPD050Fp : CCCC--CCCCCCCCCCHHHHHHHHHHHHHHHHHCCCCCHHHHHHHHH : 265
IPD050Gd : ---------CCCCCCHHHHHHHHHHHHHHHHHCCCCCCCHHHHHHHHH : 300
IPD050Ga : ---------CCCCCCCHHHHHHHHHHHHHHHHCCCCCHHHHHHHHHH : 298
IPD050Gb : ---------CCCCCCCCHHHHHHHHHHHHHHHCCCCCCHHHHHHHHH : 298
IPD050Gc : ---------CCCCCCCCHHHHHHHHHHHHHHHCCCCCCHHHHHHHHH : 298
                                  helix-1           helix-2
```

Fig. 16i

```
          --- Motif 19 --------]   [---- motif 20 ---]
                    *         420         *         440         *
IPD050Fb : EWLNNLLLQASAKS-----QGTPHHDDYRALLFRAQYVVKG-IGRSR--G : 318
IPD050Fs : KWLNTLLLQASAKS-----EGTPHHADYRALLFRAQYVVKG-VGKSR--G : 325
IPD050Fo : KWLNTLLLQASVAS-----EGTPHHSDYNALLFRAQYVIKG-VGKSR--G : 368
IPD050Fk : EWLNTLLLQASAAS-----QGTSHHDDYLALIFRAQYLIKG-VGRAR--G : 364
IPD050Fe : AWLNTHLLQASAKA-----QGTSSHDDYLALIFRAQYLLKG-MGRAR--S : 316
IPD050Fl : IWLNTHLLQASTKA-----QGTSSYDDYLALIFRSQYLLKG-MGRAR--S : 317
IPD050Fn : VWLNTHLLQASTKA-----QGTSSHDDYLALIFRAQYLLKG-MGRAR--S : 319
IPD050Ft : EWLNKILLQATKVEG----ILNSSHDEHLALLFRAQYLMKMRPGRTR--N : 350
IPD050Fh : EWLNNLLLQVIEAK-----KGKDDVEDYIQLSYRSQYILKN-VGRID--R : 368
IPD050Fg : KWLSKLLHQVIEEK-----NGKD-VEDYIGLSFRAQYVIKK-VGRIR--G : 370
IPD050Fm : EWLNNLLLQVIEAK-----RGEH-VEDYVELSFRAQYVIKK-VGRIQ--R : 365
IPD050Fd : EWLNNLLLKVIEAK-----QGQH-VEDYVELSFRAQYVIKN-VGKIQ--R : 359
IPD050Fr : EWLNNLLLKVIEAK-----QGEP-VEDYIELSFRAQYVIKK-VGRVQ--R : 360
IPD050Bb : EWLNHLLVQ---------AHAAAPNEDVITLLYRTQAFIKLKREG----- : 272
IPD050Bd : EWLNHLLVQ---------AHAAAPSDDVVALLYRTQGFIKLQRED----- : 272
IPD050Aa : EWLNHLLVQ---------AHAAAPSEDVVALLYRTQGFIKLRNEG----- : 273
IPD050Ba : EWLNHLLVQ---------AQAAAPSEDVVALLYRTQAFIKLRKEG----- : 273
IPD050Bc : EWLNYLLVQ---------ALVAAPSDDVVMLLYRTQALIKLQKEG----- : 272
IPD050Fa : EWLNKMF-----------LQLASPNDDILALLFRVQAYQKMAKQP----H : 330
IPD050Ff : LWLNKIL-----------LQVASPNDDILALLFRIQAFMKMAKEP----R : 340
IPD050Fq : LWLNKIL-----------LQVASPNDDILALLFRIQAFMKMAKQPRFVPR : 337
IPD050Fi : EWLNKILVEA--------LQVVSGNEDLLALLFRTETYLKMATES----R : 316
IPD050Fj : EWLNKILPNDDILALLFRVQLSLPNDDILALLFRVQAFLKMAKP----R : 349
IPD050Fp : QWLTTNLVQVLDDD----SLENEIREQLLALLARAELASKLPLDGSQ--N : 309
IPD050Gd : QWIVDSLLQAVHLP-----NSTTGVPELKTLLARSQMVVKLPIDGSQ--H : 343
IPD050Ga : EWIVDSLLQVVHLP-----DSTFGVAEVKTLLARAQMLMKLPTDGSQ--H : 341
IPD050Gb : EWILDSLLQVVPLP-----DSTLGVPEAKTLLARAQILMKLPTDGSQ--H : 341
IPD050Gc : EWIVDSLLQVVPLP-----NSTLGVPEVKTLLARAQMLIKLPTDGSQ--H : 341
IPD050Fb : HHHHHHHHHHCCC-----CCCCCHHHHHHHHHHHHHHHH-CCCCC--C : 318
IPD050Fs : HHHHHHHHHHCCCC----CCCCCHHHHHHHHHHHHHHHH-CCCCC--C : 325
IPD050Fo : HHHHHHHHHHCCCC----CCCCCCHHHHHHHHHHHHHHH-HCCCC--C : 368
IPD050Fk : HHHHHHHHHHHHCC----CCCCCCHHHHHHHHHHHHHHH-CCCCC--C : 364
IPD050Fe : HHHHHHHHHHCCC-----CCCCCCHHHHHHHHHHHHHHH-CCCCC--C : 316
IPD050Fl : HHHHHHHHHCCCC-----CCCCCHHHHHHHHHHHHHHHH-CCCCC--C : 317
IPD050Fn : HHHHHHHHHHCCCC----CCCCCHHHHHHHHHHHHHHHH-CCCCC--C : 319
IPD050Ft : HHHHHHHHHHHHHH----CCCCCCHHHHHHHHHHHHHHHHCCCCCC--C : 350
IPD050Fh : HHHHHHHHHHHHHH-----CCCCCHHHHHHHHHHHHHHHH-HCCCC--C : 368
IPD050Fg : HHHHHHHHHHHHC-----CCCC-HHHHHHHHHHHHHHHH-HCCCC--C : 370
IPD050Fm : HHHHHHHHHHHHHH-----CCCC-CHHHHHHHHHHHHHH-HCCCC--C : 365
IPD050Fd : HHHHHHHHHHHHHH-----CCCC-HHHHHHHHHHHHHHHH-HCCCC--C : 359
IPD050Fr : HHHHHHHHHHHHHH-----CCCC-HHHHHHHHHHHHHHHH-HCCCC--C : 360
IPD050Bb : HHHHHHHH---------HCCCCCCHHHHHHHHHHHHHHCCCCC----- : 272
IPD050Bd : HHHHHHHH---------HCCCCCCHHHHHHHHCCCCCCCCC----- : 272
IPD050Aa : HHHHHHHH---------HCCCCCCHHHHHHHHHHHHHCCCC----- : 273
IPD050Ba : HHHHHHHH---------HHCCCCCHHHHHHHHHHHHHHCCCC----- : 273
IPD050Bc : HHHHHHHH---------HHHCCCCHHHHHHHHHHHHHCCCC----- : 272
IPD050Fa : HHHHHHH----------HCCCCCCHHHHHHHHHHHHHHHCCC----C : 330
IPD050Ff : HHHHHHH----------HHHCCCCHHHHHHHHHHHHHHHCCCC----C : 340
IPD050Fq : HHHHHHH----------HHHCCCCHHHHHHHHHHHHHHHCCCCCCC : 337
IPD050Fi : HHHHHHHHHH--------HHCCCCHHHHHHHHHHHHHHHCCC----C : 316
IPD050Fj : HHHHHHCCCHHHHHHHHHCCCCCHHHHHHHHHHHHHHHHCCC----C : 349
IPD050Fp : HHHHHHHHHHCCC----CCHHHHHHHHHHHHHHHHCCCCCCCC--C : 309
IPD050Gd : HHHHHHHHHHCCCC-----CCCCCHHHHHHHHHHHHHHHCCCCCCCC--C : 343
IPD050Ga : HHHHHHHHHHCCCC-----CCCHHHHHHHHHHHHHHHHCCCCCCCC--C : 341
IPD050Gb : HHHHHHCCCCCCCC-----CCCCCHHHHHHHHHHHHHHHCCCCCCCC--C : 341
IPD050Gc : HHHHHHHCCCCCCC-----CCCCCCHHHHHHHHHHHHHHCCCCCCCC--C : 341
                                   helix-3
```

Fig. 16j

```
          [----- Motif 13 -------][---------- motif 2 -------
                   460         *        480         *        500
IPD050Fb : AVVPQLQYDMYSNLINQMARAADSYDQSLKQLKLFIAQ---NEILGEYLL : 365
IPD050Fs : AVVPQLQYDMYSNLVNQVARAADSYDQSLKQLQLFITQ---NEILGDYLL : 372
IPD050Fo : AVVPQLQYDMYSNLVNQVARAADSYDQSLKQLQLFIAQ---NEILGEYLL : 415
IPD050Fk : AVVPQLQYDMYSNLINQMARAADTYDQSLKQFQLFVAQ---NKILGGYLL : 411
IPD050Fe : LVVPQLQYDVYRNLISQMARVAESYDQSLKQLQLFVAQ---NKILGGYLL : 363
IPD050Fl : LVVPQLQYDVYRNLINQMARVAESYDQSLKQLQLFLAQ---NKVLGGYLL : 364
IPD050Fn : LVVPQLQYDVYRNLINQMARVAESYDQSLKQLQLFLAQ---NKILGGYLL : 366
IPD050Ft : LVVPQLQYDVYSNLVNRMAQVAESYDQSLRQFKLFIDQ---NKILGSYLL : 397
IPD050Fh : FVVPQLQYDTYSPLINRMAQVAESYDQALRQFRLFIQQTQQNKILGAFLL : 418
IPD050Fg : LVVPQLQYDVYSNLINRMAQVAESYDQALRQFRLFIQN---NKILGGFLL : 417
IPD050Fm : LVVPQLQYSAYSNLINRLAQVAESYDQALRQFRLFIQQ---NKILGGFLL : 412
IPD050Fd : MVVPQLQYSAYSNLINRMAQVAESYDQALRQFKLFIQQ---NKILGGFLL : 406
IPD050Fr : LVVPQLQYSAYSNLINRLAQVAENYDQALRQFRLFIQQ---NKILGGFLL : 407
IPD050Bb : LVVPRLQYHMYKNLIDRMVQVAQNYDQFRQLKLFVEQ---NKILGSYLL : 319
IPD050Bd : LVVPGLQYRMYKDLINRMVQVAQSYDQFKQLKLYVEQ---NKILGSYLL : 319
IPD050Aa : LIVPRLQYRMYKDLIDRMVQVAQSYDQFKQLKLFVEQ---NKILGSYLL : 320
IPD050Ba : LIVPRLQYHMYKDLIDRMVQVAQSYDQFKQMKLYVEQ---NKILGSYLL : 320
IPD050Bc : LIVPRLQYHKYKDLIDRMVQVAQSYDHDFKQLKLYVEQ---NKILGSYLL : 319
IPD050Fa : PVVPRMRYSRYEGLINQMVQIAQSYDQDLKQLKLFIAQ---NEILGSYLL : 377
IPD050Ff : FVVPRLQYHMYGSLINRMVQVAQNYDQEFKQLKLFIAQ---NKILGSYLL : 387
IPD050Fq : FVVPRLQYHMYGSLINRMVQVAQNYDQEFKQLKLFIAQ---NEILGSYLL : 384
IPD050Fi : SVVPRLQYHMYSDLIHRMVQVAQAYDDEFQRLRLFIAQ---NEILGSYLL : 363
IPD050Fj : SVVPRLQYHMYSPLINRMVQVAQVYDQEFKQLKLFIVQ---NQILGSYLL : 396
IPD050Fp : LIVPRLEYGQYRGLISSMAAVAEAYNSEFTAVNLFIQQ---NEILGSYLL : 356
IPD050Gd : LKVPLLVYGEFQEDIDQLLRNAEAYDQEYRQLTRFVQQ---VQIIGSEFL : 390
IPD050Ga : LQVPLLAYGEYQEDIDQLLRNAEAYDQEYRELTRFVQQ---VEIIGNEFL : 388
IPD050Gb : LRVPLLAYGEYQEDIERLLRNAEAYDQEYRELTRFVQL---VEIIGSEFL : 388
IPD050Gc : LRVPLLAYGEYQEDIERLLRNAEAYDQEYRALTRFVQL---VEIIGSEFL : 388
IPD050Fb : CCCCCCCHHHHHHHHHHHHHHHHHHHHHHHHHHHHH---HHHHHHHH : 365
IPD050Fs : CCCCCCCHHHHHHHHHHHHHHHHHHHHHHHHHHHHH---HHHHHHHH : 372
IPD050Fo : CCCCCCCHHHHHHHHHHHHHHHHHHHHHHHHHHHHH---HHHHHHHH : 415
IPD050Fk : CCCCCCCHHHHHHHHHHHHHHHHHHHHHHHHHHHHH---HHHHHHHH : 411
IPD050Fe : CCCCCCCHHHHHHHHHHHHHHHHHHHHHHHHHHHHH---HHHHHHHH : 363
IPD050Fl : CCCCCCCHHHHHHHHHHHHHHHHHHHHHHHHHHHHH---HHHHHHHH : 364
IPD050Fn : CCCCCCCHHHHHHHHHHHHHHHHHHHHHHHHHHHHH---HHHHHHHH : 366
IPD050Ft : CCCCCCCHHHHHHHHHHHHHHHHHHHHHHHHHHHHH---HHHHHHHH : 397
IPD050Fh : CCCCCCCHHHHHHHHHHHHHHHHHHHHHHHHHHHHHHHHHHHHHHH : 418
IPD050Fg : CCCCCCCHHHHHHHHHHHHHHHHHHHHHHHHHHHHH---HHHHHHHH : 417
IPD050Fm : CCCCCCCHHHHHHHHHHHHHHHHHHHHHHHHHHHHH---HHHHHHHH : 412
IPD050Fd : CCCCCCCHHHHHHHHHHHHHHHHHHHHHHHHHHHHH---HHHHHHHH : 406
IPD050Fr : CCCCCCCHHHHHHHHHHHHHHHHHHHHHHHHHHHHH---HHHHHHHH : 407
IPD050Bb : CCCCCCCHHHHHHHHHHHHHHHHHHHHHHHHHHHHH---HHHHHHHH : 319
IPD050Bd : CCCCCCCHHHHHHHHHHHHHHHHHHHHHHHHHHHHH---HHHHHHHH : 319
IPD050Aa : CCCCCCCHHHHHHHHHHHHHHHHHHHHHHHHHHHHH---HHHHHHHH : 320
IPD050Ba : CCCCCCCHHHHHHHHHHHHHHHHHHHHHHHHHHHHH---HHHHHHHH : 320
IPD050Bc : CCCCCCCHHHHHHHHHHHHHHHHHHHHHHHHHHHHH---HHHHHHHH : 319
IPD050Fa : CCCCCCCHHHHHHHHHHHHHHHHHHHHHHHHHHHHH---HHHHHHHH : 377
IPD050Ff : CCCCCCCHHHHHHHHHHHHHHHHHHHHHHHHHHHHH---HHHHHHHH : 387
IPD050Fq : CCCCCCCHHHHHHHHHHHHHHHHHHHHHHHHHHHHH---HHHHHHHH : 384
IPD050Fi : CCCCCCCHHHHHHHHHHHHHHHHHHHHHHHHHHHHH---HHHHHHHH : 363
IPD050Fj : CCCCCCCCCCHHHHHHHHHHHHHHHHHHHHHHHHHHH---HHHHHHHH : 396
IPD050Fp : CCCCCCCHHHHHHHHHHHHHHHHHHHHHHHHHHHHH---HHHHHHHH : 356
IPD050Gd : CCCCCCCHHHHHHHHHHHHHHHHHHHHHHHHHHHHH---HHHHHHHH : 390
IPD050Ga : CCCCCCCHHHHHHHHHHHHHHHHHHHHHHHHHHHHH---HHHHHHHH : 388
IPD050Gb : CCCCCCCHHHHHHHHHHHHHHHHHHHHHHHHHHHHH---HHHHHHHH : 388
IPD050Gc : CCCCCCCHHHHHHHHHHHHHHHHHHHHHHHHHHHHH---HHHHHHHH : 388
                                       helix 4
```

Fig. 16k

```
                     -----------------]  [--------- motif 12 ---------
                     *         520         *         540         *
IPD050Fb : EQNRVFAAKERDMEVFHSELIAQKTTELQTVMVKIDNLSLQMEAQVEDME : 415
IPD050Fs : EQNRVFAAKERDMEVFHSELIAQKKTELLTVMAKIDLLSLQMETQAADME : 422
IPD050Fo : EQNRVFAAKERDMEVFHSELISQKETELRTVVAKIDLLSLQMETQVADME : 465
IPD050Fk : EQNRAFAAKERDMEVFHSELIAQKKTELQTVMVKIDKLSLQMDTQVADME : 461
IPD050Fe : EQNRAFAAKERDMEVFHSELIAQKELELKNTMVKMEQLSLQMETQIADMD : 413
IPD050Fl : EQNRAFAAKERDMEVFHSELIAQKELELQNTMFKMEQLSSQMETQIADMD : 414
IPD050Fn : EQNRAFAAKERDMEVFHSELIAQKELELQNTMFKMEQLSSQMETQIADMD : 416
IPD050Ft : QQNKAFADKERDMDVFHSELISQRKIELDNTILKMDQLSLQMESQREDMD : 447
IPD050Fh : DQNRAFADKEKDMDIFYSELIAQRQIELHNTLQKMEQLSLQMETQSADME : 468
IPD050Fg : EQNRAFAEKEKDMDVFYSELITQRQIELDNTLQKLKRLSLQMETQQADME : 467
IPD050Fm : EQNRAFAEKEQDMDVFYSELIAQRQIELDNTLQKMKHLGAQMETQTADME : 462
IPD050Fd : EQNRAFAEKEQDMDVFYSELITQRQIELDNTLQKMKHLGTQMDTQTADME : 456
IPD050Fr : EQNRAFAEREQDMDVFYSELITQRKIELDNTLQTMKHLGAQMETQTAGME : 457
IPD050Bb : EQNKAFAEKEKDMDAFHSQIIALRTTELNNTIERMGELSKQMDQENEAME : 369
IPD050Bd : EQNKAFAEKEKDMDAFHSQVIALRTTELNNTIERMDDLSKQMEEQNAAME : 369
IPD050Aa : EQNKAFAEKEKDMDAFHSQVIDLRTSELESTIERMDDLSKQMEEQNAAME : 370
IPD050Ba : EQNKAFAEKEKDMDASHSQVIALRTSELQSTIERMDDLSKQMEVQSTAME : 370
IPD050Bc : DQNKAFAEKEKDMDASHSQLIALRTSELESTIERMSDLSKQMEVQSKAMK : 369
IPD050Fa : EQNKAFAAKEKSMSEFHLQVSDLRRSELNDAIQKMTGLGEEMEVEKEAMD : 427
IPD050Ff : QQNRAFAEREREMSAFHSQVVSMRRSELQSAIQTMDNLSLQMESESEAMN : 437
IPD050Fq : QQNKAFAEREKEMSAFHSQVVSMRRSELTTAIETMNQLSLQMETESEAMN : 434
IPD050Fi : EQNKALASREREMSAFHSQVVSLRRTELDNCLQRMDQLNVQMERENKAME : 413
IPD050Fj : EQNKAFASRETEMSSFHSQVVSLRRTELNNAIDRIDQLSVQMENENEAMD : 446
IPD050Fp : QQNKAFAAREKDMEAFHGLVVERKRQELSSAQETMEELNVQLTQQTEAMD : 406
IPD050Gd : QLSMSLAQKERQIETFQSLLVIRKQSELDQTMRRIDSLMREIERRSFEMA : 440
IPD050Ga : QLSRSLAEKERQIEIFESLVVIRKQSELDQAIRRMNSLMTEIERRSYEMA : 438
IPD050Gb : QLSRSLAQRERDIEAFESLAVIRKQSELDQAIRRMNSLMPEIERRSFEMA : 438
IPD050Gc : QLSKTLAQRERDIETFESLVVIRKQSELDQAIRRMNSLMTEIERRSFEMA : 438
IPD050Fb : HHHHHHHHHHHHHHHHHHHHHHHHHHHHHHHHHHHHHHHHHHHHHHHHH : 415
IPD050Fs : HHHHHHHHHHHHHHHHHHHHHHHHHHHHHHHHHHHHHHHHHHHHHHHHH : 422
IPD050Fo : HHHHHHHHHHHHHHHHHHHHHHHHHHHHHHHHHHHHHHHHHHHHHHHHH : 465
IPD050Fk : HHHHHHHHHHHHHHHHHHHHHHHHHHHHHHHHHHHHHHHHHHHHHHHHH : 461
IPD050Fe : HHHHHHHHHHHHHHHHHHHHHHHHHHHHHHHHHHHHHHHHHHHHHHHHH : 413
IPD050Fl : HHHHHHHHHHHHHHHHHHHHHHHHHHHHHHHHHHHHHHHHHHHHHHHHH : 414
IPD050Fn : HHHHHHHHHHHHHHHHHHHHHHHHHHHHHHHHHHHHHHHHHHHHHHHHH : 416
IPD050Ft : HHHHHHHHHHHHHHHHHHHHHHHHHHHHHHHHHHHHHHHHHHHHHHHHH : 447
IPD050Fh : HHHHHHHHHHHHHHHHHHHHHHHHHHHHHHHHHHHHHHHHHHHHHHHHH : 468
IPD050Fg : HHHHHHHHHHHHHHHHHHHHHHHHHHHHHHHHHHHHHHHHHHHHHHHHH : 467
IPD050Fm : HHHHHHHHHHHHHHHHHHHHHHHHHHHHHHHHHHHHHHHHHHHHHHHHH : 462
IPD050Fd : HHHHHHHHHHHHHHHHHHHHHHHHHHHHHHHHHHHHHHHHHHHHHHHHH : 456
IPD050Fr : HHHHHHHHHHHHHHHHHHHHHHHHHHHHHHHHHHHHHHHHHHHHHHHHH : 457
IPD050Bb : HHHHHHHHHHHHHHHHHHHHHHHHHHHHHHHHHHHHHHHHHHHHHHHHH : 369
IPD050Bd : HHHHHHHHHHHHHHHHHHHHHHHHHHHHHHHHHHHHHHHHHHHHHHHHH : 369
IPD050Aa : HHHHHHHHHHHHHHHHHHHHHHHHHHHHHHHHHHHHHHHHHHHHHHHHH : 370
IPD050Ba : HHHHHHHHHHHHHHHHHHHHHHHHHHHHHHHHHHHHHHHHHHHHHHHHH : 370
IPD050Bc : HHHHHHHHHHHHHHHHHHHHHHHHHHHHHHHHHHHHHHHHHHHHHHHHH : 369
IPD050Fa : HHHHHHHHHHHHHHHHHHHHHHHHHHHHHHHHHHHHHHHHHHHHHHHHH : 427
IPD050Ff : HHHHHHHHHHHHHHHHHHHHHHHHHHHHHHHHHHHHHHHHHHHHHHHHH : 437
IPD050Fq : HHHHHHHHHHHHHHHHHHHHHHHHHHHHHHHHHHHHHHHHHHHHHHHHH : 434
IPD050Fi : HHHHHHHHHHHHHHHHHHHHHHHHHHHHHHHHHHHHHHHHHHHHHHHHH : 413
IPD050Fj : HHHHHHHHHHHHHHHHHHHHHHHHHHHHHHHHHHHHHHHHHHHHHHHHH : 446
IPD050Fp : HHHHHHHHHHHHHHHHHHHHHHHHHHHHHHHHHHHHHHHHHHHHHHHHH : 406
IPD050Gd : HHHHHHHHHHHHHHHHHHHHHHHHHHHHHHHHHHHHHHHHHHHHHHHHH : 440
IPD050Ga : HHHHHHHHHHHHHHHHHHHHHHHHHHHHHHHHHHHHHHHHHHHHHHHHH : 438
IPD050Gb : HHHHHHHHHHHHHHHHHHHHHHHHHHHHHHHHHHHHHHHHHHHHHHHHH : 438
IPD050Gc : HHHHHHHHHHHHHHHHHHHHHHHHHHHHHHHHHHHHHHHHHHHHHHHHH : 438
                                  helix 4
```

Fig. 161

```
              --------]  [----------- motif 11 ----------][-
                 560         *         580         *         600
IPD050Fb  : QAREDMEAG-LRRFRNRQVANAMFSVFRAIGAVALTVLTGG-----AAAP : 459
IPD050Fs  : QAREDMEAG-LRRFRNRQVANAMFAVFRAIGAVALTVLTGG-----AAAP : 466
IPD050Fo  : QAREDMEAG-LRRFRNRQVANAIFSVFRAIAAVALTVVTGG-----AAAP : 509
IPD050Fk  : QAREDMEAG-LRRFRDRQVANALFSVFRAIGAVALTVLTGG-----AAAP : 505
IPD050Fe  : QAKEDMDAG-LRRFQNRQVANAMFAVFRAIGAIALTVVTAG-----AAAP : 457
IPD050Fl  : QAEKDMEAG-LRRFQNRQVARAIFAVFRAIGAVALTVVTGG-----AAAP : 458
IPD050Fn  : QAEKDMEAG-LRRFQNRQVARAMFAVFRAIGAVALTVVTGG-----AAAP : 460
IPD050Ft  : QAKKDMDAG-LREFQNRQVANAMFAVIGAIAAIGLAFITGG-----ATAP : 491
IPD050Fh  : QAQADMEAG-LRRFQNERVARAVFGVLGAIAAVALAFVTGG-----ATAG : 512
IPD050Fg  : QAQADMEAG-LRRFQNRQAARALFAVLGAIAAVGLAFLTGG-----ATAP : 511
IPD050Fm  : QAQADMEAG-IREFQNRQVARGLFAVLGAIAAVGLTLLTGG-----AAAP : 506
IPD050Fd  : QAQADMEAG-VRKFQNEQVARGLFAVLGAIGAVGLTFLTGG-----AAAP : 500
IPD050Fr  : QAQADMEAAGIRRFQNAQVARGLFAVLGAIAAVGLTLLTGG-----AAAP : 502
IPD050Bb  : QAKADMDAG-LIEYQNRQVANALFAVLGAIASIGLAFATGG-----ATAP : 413
IPD050Bd  : QAKADMDAG-LIEYQNKQVANAVFAVLGAIASIGLAFATGG-----ATAP : 413
IPD050Aa  : QAKADMDAG-LIAYQNKQVANAVFAVLGAIASIGLAFATGG-----ATAP : 414
IPD050Ba  : KAKADMDAG-LIVYQNKQVADAVFAVMEAIASIGLAFATGG-----ATAP : 414
IPD050Bc  : QAKADMDAG-LVEYQDKQVADAVFAVLEAVASIGLAVATGG-----ASAP : 413
IPD050Fa  : QAYKDMEQG-LQEYEKRQIVTAVFAVISAISLCALGFVTGGAT--VAAVP : 474
IPD050Ff  : EAQENMVEA-IQEYERKLLARALFSVIGAIASVALAFATGG-----ATAP : 481
IPD050Fq  : EAQENMVEA-IQEYERKLLARALFSVIGAIASVALAVATGG-----ATAP : 478
IPD050Fi  : EAQEKMNEA-LEAHQRRGLARALFAVLGAIAAVALTVATGG-----AAAP : 457
IPD050Fj  : QAKEDMMQA-IAEYEKKQLANALFAVLGAIASVALAFATAG-----ATAP : 490
IPD050Fp  : QAKEDMEAG-LKKYRDAQAARAFFAVMKGVLEIGAAIFTGG-----ATMG : 450
IPD050Gd  : DARYRMEEG-VLDHYRRQVNRAVFGMLGALLQLFASLKFGGGADIAGAME : 489
IPD050Ga  : DARSEMEQG-LEDYHRRQLTRAIFGILGALLQLCASLKFGGGADIAGGIA : 487
IPD050Gb  : DAKARMEEG-LEDYNRRQLTRAIFGILGALLQLCASLKFGGGADIAGGIA : 487
IPD050Gc  : DAKARMEEG-LQDYNRRQLTRAIFGILGALLQLCASLKFGGGADIAGGIA : 487
IPD050Fb  : HHHHHHHHH-HHHHHHHHHHHHHHHHHHHHHHHHHHHHHHCC-----CCCC : 459
IPD050Fs  : HHHHHHHHH-HHHHHHHHHHHHHHHHHHHHHHHHHHHHHHHC-----CCCH : 466
IPD050Fo  : HHHHHHHHH-HHHHHHHHHHHHHHHHHHHHHHHHHHHHHHCC-----CCCH : 509
IPD050Fk  : HHHHHHHHH-HHHHHHHHHHHHHHHHHHHHHHHHHHHHHHCC-----CCCC : 505
IPD050Fe  : HHHHHHHHH-HHHHHHHHHHHHHHHHHHHHHHHHHHHHHHHC-----CCCH : 457
IPD050Fl  : HHHHHHHHH-HHHHHHHHHHHHHHHHHHHHHHHHHHHHHHHC-----CCCH : 458
IPD050Fn  : HHHHHHHHH-HHHHHHHHHHHHHHHHHHHHHHHHHHHHHHCC-----CCCH : 460
IPD050Ft  : HHHHHHHHH-HHHHHHHHHHHHHHHHHHHHHHHHHHHHHHCC-----CCCH : 491
IPD050Fh  : HHHHHHHHH-HHHHHHHHHHHHHHHHHHHHHHHHHHHHHHCC-----CCCC : 512
IPD050Fg  : HHHHHHHHH-HHHHHHHHHHHHHHHHHHHHHHHHHHHHHHCC-----CCCH : 511
IPD050Fm  : HHHHHHHHH-HHHHHHHHHHHHHHHHHHHHHHHHHHHHHCCC-----CCCC : 506
IPD050Fd  : HHHHHHHHH-HHHHHHHHHHHHHHHHHHHHHHHHHHHHHHCC-----CCCC : 500
IPD050Fr  : HHHHHHHHHHHHHHHHHHHHHHHHHHHHHHHHHHHHHHHHCC-----CCCH : 502
IPD050Bb  : HHHHHHHHH-HHHHHHHHHHHHHHHHHHHHHHHHHHHHHHCC-----CCCC : 413
IPD050Bd  : HHHHHHHHH-HHHHHHHHHHHHHHHHHHHHHHHHHHHHHHCC-----CCCH : 413
IPD050Aa  : HHHHHHHHH-HHHHHHHHHHHHHHHHHHHHHHHHHHHHHHCC-----CCCH : 414
IPD050Ba  : HHHHHHHHH-HHHHHHHHHHHHHHHHHHHHHHHHHHHHHHCC-----CCCH : 414
IPD050Bc  : HHHHHHHHH-HHHHHHHHHHHHHHHHHHHHHHHHHHHHHHCC-----CCCH : 413
IPD050Fa  : HHHHHHHHH-HHHHHHHHHHHHHHHHHHHHHHHHHHHHHHCCCC--CCCCH : 474
IPD050Ff  : HHHHHHHHH-HHHHHHHHHHHHHHHHHHHHHHHHHHHHHHHC-----CCCH : 481
IPD050Fq  : HHHHHHHHH-HHHHHHHHHHHHHHHHHHHHHHHHHHHHHHHC-----CCCC : 478
IPD050Fi  : HHHHHHHHH-HHHHHHHHHHHHHHHHHHHHHHHHHHHHHCCC-----CCCH : 457
IPD050Fj  : HHHHHHHHH-HHHHHHHHHHHHHHHHHHHHHHHHHHHHHHHC-----CCCH : 490
IPD050Fp  : HHHHHHHHH-HHHHHHHHHHHHHHHHHHHHHHHHHHHHHHCC-----CCCH : 450
IPD050Gd  : HHHHHHHHH-HHHHHHHHHHHHHHHHHHHHHHHHHHHHCCCCCCCCHHHH : 489
IPD050Ga  : HHHHHHHHH-HHHHHHHHHHHHHHHHHHHHHHHHHHHHCCCCCCCCCHHH : 487
IPD050Gb  : HHHHHHHHH-HHHHHHHHHHHHHHHHHHHHHHHHHHHHCCCCCCCCCHH  : 487
IPD050Gc  : HHHHHHHHH-HHHHHHHHHHHHHHHHHHHHHHHHHHHHCCCCCCCCCCCC : 487
                                              helix 4
```

Fig. 16m

```
            -- Motif 21 --] [------------- motif 9 -----------
                    *        620         *        640         *
IPD050Fb : LAISAAKGAVSIAG--QAARGLERVLRILDDLQAAMELLKIIKDLVESLQ : 507
IPD050Fs : LAISTAKGAVSIAG--QAARGLQRVLQILDDLQAAMELLKIIKDLVESLQ : 514
IPD050Fo : LAMSTAKGAVSAAG--QAARGLERVLQILDDLQAAMELLKIIKDLLESLQ : 557
IPD050Fk : LAISAAKGAVSIAG--QAARGLERVLQILDDLQAAMELLKIIKDLVESLQ : 553
IPD050Fe : AAMAAAKGAVTTAG--QAARGLVRVLEILDDLQAAMEVFKLIKDLVESLR : 505
IPD050Fl : AAMSAAKGAVSIAG--QAARGLERVLEILDNLQAAMEVFKIIKDLVESLR : 506
IPD050Fn : AAMTAAKGAVSIAG--QAARGLERVLEILDNLQAAMEVFKIIKDLVESLR : 508
IPD050Ft : AAVGAAKTAVTAAG--AAARALERVVEILDSLQAVMEIVSIIKELVSSLQ : 539
IPD050Fh : AAIGAAKTAVTLAG--AAARGLQQVLEILDGLQAVMEVVGMIKELFESLQ : 560
IPD050Fg : AALGAARTAVTVAG--SVVSGLQRVLEVLEGLQAVMEIVVIKDLFSALQ  : 559
IPD050Fm : LAMSAARSAVSLAG--AVAQGLQRVLDILEGLQVVMEVVELINDLISSLQ : 554
IPD050Fd : LAISTARRAVSVAG--AVAQGLQTVLDILEGLQAVMEIVHLINDLISALQ : 548
IPD050Fr : LAVSAARRVVTVAG--AVAQGLQRVIDILEGLQVVMEVVELINDLISSLQ : 550
IPD050Bb : GAVSAAGAAVTAAG--KAAEGLKKVVEILEGLQVVMEVVAAIKELVQSLQ : 461
IPD050Bd : GAVAAAGTAVTAAG--KAAEGLKKVVEILEGLQAVMEVVAAIKELVQSLQ : 461
IPD050Aa : GAVASAGAAVTAAG--KAAEGLKKVVEILEGLQAVMEVVAVIKELVQSLQ : 462
IPD050Ba : GAVASAGAAVSAAG--KAGEGLKKVVEILEGLQAIMEVIAAIKGLVQSLQ : 462
IPD050Bc : EAVASAGAAVSAAG--KAAEGLKKVVEVLEGLKAVMEVIAAINKLVQSIQ : 461
IPD050Fa : GAVANAAQAVSAAV--SLANKLQKVMGILEIINQVVQTAAAIKEVIELFD : 522
IPD050Ff : GAVAAAGGAVAAAG--RLAAGLQKVVDILQGLQAVMEVVVAIRDIVESLK : 529
IPD050Fq : GAVAAARGAVTAAG--RLAQGLQKVVDILQGLQAVMEVVVAIRDIVESLK : 526
IPD050Fi : AAVAAAGQAVTAAG--TLAQGLKTVVEILEGLQALMDLVVIIRELVENLQ : 505
IPD050Fj : GAVAAAGAAVSAAG--RLAEGLKKVVEILEGLAAVMEIVAAIRDLVESLQ : 538
IPD050Fp : LAVQGGINAVKAVS--SLAGKLDMVLQIMEGMEKVMEVLNAIDDLVAAVS : 498
IPD050Gd : TTVSAAIDIIHAVEDASASSKLLPMTKNLIDLEKMIEVVNAVNELVENAT : 539
IPD050Ga : TTVPAAIDMIHAVEDASANTKLLAISQSLMDLEKIVDVVNAVNALVESAT : 537
IPD050Gb : TTVPAAIDLIHAVQDTSASTKLLAISQTLMDLEKIVDVVNAVNTLAESAT : 537
IPD050Gc : TTVPAAIDLIHAVQDDSASTKLLAISQTLMDLEKIVDVVNAVNELVESAT : 537
IPD050Fb : HHHHHHHHHHHHH--HHHHHHHHHHHHHHHHHHHHHHHHHHHHHHHHHHH : 507
IPD050Fs : HHHHHHHHHHHHH--HHHHHHHHHHHHHHHHHHHHHHHHHHHHHHHHHHH : 514
IPD050Fo : HHHHHHHHHHHHH--HHHHHHHHHHHHHHHHHHHHHHHHHHHHHHHHHHH : 557
IPD050Fk : HHHHHHHHHHHHH--HHHHHHHHHHHHHHHHHHHHHHHHHHHHHHHHHHH : 553
IPD050Fe : HHHHHHHHHHHHH--HHHHHHHHHHHHHHHHHHHHHHHHHHHHHHHHHHH : 505
IPD050Fl : HHHHHHHHHHHHH--HHHHHHHHHHHHHHHHHHHHHHHHHHHHHHHHHHH : 506
IPD050Fn : HHHHHHHHHHHHH--HHHHHHHHHHHHHHHHHHHHHHHHHHHHHHHHHHH : 508
IPD050Ft : HHHHHHHHHHHHH--HHHHHHHHHHHHHHHHHHHHHHHHHHHHHHHHHHH : 539
IPD050Fh : HHHHHHHHHHHHH--HHHHHHHHHHHHHHHHHHHHHHHHHHHHHHHHHHH : 560
IPD050Fg : HHHHHHHHHHHHH--HHHHHHHHHHHHHHHHHHHHHHHHHHHHHHHHHHH : 559
IPD050Fm : HHHHHHHHHHHHH--HHHHHHHHHHHHHHHHHHHHHHHHHHHHHHHHHHH : 554
IPD050Fd : HHHHHHHHHHHHH--HHHHHHHHHHHHHHHHHHHHHHHHHHHHHHHHHHH : 548
IPD050Fr : HHHHHHHHHHHHH--HHHHHHHHHHHHHHHHHHHHHHHHHHHHHHHHHHH : 550
IPD050Bb : HHHHHHHHHHHHH--HHHHHHHHHHHHHHHHHHHHHHHHHHHHHHHHHHH : 461
IPD050Bd : HHHHHHHHHHHHH--HHHHHHHHHHHHHHHHHHHHHHHHHHHHHHHHHHH : 461
IPD050Aa : HHHHHHHHHHHHH--HHHHHHHHHHHHHHHHHHHHHHHHHHHHHHHHHHH : 462
IPD050Ba : HHHHHHHHHHHHH--HHHHHHHHHHHHHHHHHHHHHHHHHHHHHHHHHHH : 462
IPD050Bc : HHHHHHHHHHHHH--HHHHHHHHHHHHHHHHHHHHHHHHHHHHHHHHHHH : 461
IPD050Fa : HHHHHHHHHHHHH--HHHHHHHHHHHHHHHHHHHHHHHHHHHHHHHHHHH : 522
IPD050Ff : HHHHHHHHHHHHH--HHHHHHHHHHHHHHHHHHHHHHHHHHHHHHHHHHH : 529
IPD050Fq : HHHHHHHHHHHHH--HHHHHHHHHHHHHHHHHHHHHHHHHHHHHHHHHHH : 526
IPD050Fi : HHHHHHHHHHHHH--HHHHHHHHHHHHHHHHHHHHHHHHHHHHHHHHHHH : 505
IPD050Fj : HHHHHHHHHHHHH--HHHHHHHHHHHHHHHHHHHHHHHHHHHHHHHHHHH : 538
IPD050Fp : HHHHHHHHHHHHH--HHHHHHHHHHHHHHHHHHHHHHHHHHHHHHHHHHH : 498
IPD050Gd : HHHHHHHHHHHHHHHHHHCCCCCCCCCHHHHHHHHHHHHHHHHHHHHHHH : 539
IPD050Ga : HHHHHHHHHHHHHHHHHHHHHHHHHHHHHHHHHHHHHHHHHHHHHHHHHH : 537
IPD050Gb : HHHHHHHHHHHHHHHHHHHHHHHHHHHHHHHHHHHHHHHHHHHHHHHHHH : 537
IPD050Gc : CHHHHHHHHHHHHHHHCHHHHHHHHHHHHHHHHHHHHHHHHHHHHHHHHH : 537
                                       helix 5
```

Fig. 16n

```
                -----------------][------ motif 6 -------][-------
                      660         *        680         *       700
IPD050Fb  : EIGQLVDAPDMPEMPTEADWAIFVNEIEGVAEQMPEEVS-EVSAWKTSCK : 556
IPD050Fs  : EVGQLVDAPDMPEMPTEADWAIFVNEIEGVAEQMPEEVS-EVSAWKTSCK : 563
IPD050Fo  : AVGQLVDAPDMPEMPTEADWAIFVNEIEGVAEQMPEEVS-EVSAWKTSSK : 606
IPD050Fk  : EVGQLVDAPEMPDMPTEVDWAIFVNEVEGVAEQMPEEVS-EVSAWKTSCK : 602
IPD050Fe  : EVGQLVDAPDMPDMPTEADWSIFVNEIEGVAEQMPEEVS-EVSAWKTSCK : 554
IPD050Fl  : EVGQLVDAPEMPDMPTEADWSIFVNEVEAVAEQMPEEVS-EVSAWKTSCK : 555
IPD050Fn  : EVGQLVDAPEMPDMPTEADWSIFVNEVEAVAEQMPEEVS-EVSAWKTSCK : 557
IPD050Ft  : EIGQLVEAPDMPPMPTEADWFIFENEIEGVAEQMPTEVS-EVSAWKTKCK : 588
IPD050Fh  : ELGQAVDLPEMPEMPLESDWHIFVNEVEAVAEQMPTEVS-EVVAWKTKCK : 609
IPD050Fg  : DLTQAVDLPDMPEMPLQSDWLIFVNEVEAVAQGMPTEVS-EVVAWKTKCK : 608
IPD050Fm  : ELGQPVELPEMAEMPTEADWLIFVNEVEGVAEQMPTEVS-EVVAWKTKCK : 603
IPD050Fd  : ELGQPVELPEMADMPTEADWLIFVNEVEGVAEQMPTEVS-EVVAWKTKCK : 597
IPD050Fr  : DLGQPVDLPEMAELPTQADWLIFVNEVEGVAEQMPTEVS-EVVAWKTKCK : 599
IPD050Bb  : QIGQLVDAPEMPDLPSNADWEIFVNEVEAVAEQMPTEVT-QVAAWKAKCK : 510
IPD050Bd  : EIGQLVNAPEMPDLPSNAEWDIFVNEVEAVAEQMPTEVT-EVPAWKAKCK : 510
IPD050Aa  : EIGQLVDAPEMPDLPSDAEWEIFVNEVEAVAEQMPTEVT-EVPAWKAKCK : 511
IPD050Ba  : KIGQLVNAPEMPDLPSEAEWEMFVKEVEAVAAQMPTEVT-QVPAWTAKCK : 511
IPD050Bc  : KIGQLVSAPEMPDLPSDAKWEIFVNEVEAVAAQMPKEVS-QVPAWTAKCK : 510
IPD050Fa  : NMGQLLEAPEMPEMPSNYDWLIFVNEVEAMAEQLPVEVN-ERIVWKAKCK : 571
IPD050Ff  : NMGQLVEAPEMPEMPTDADWLIFVNEVEAVAEQVPTEVA-EVPVWKAKCK : 578
IPD050Fq  : NMGQLVEAPEMPEMPTDADWLIFVNEVEAVAEQVPTEVA-EVPVWKAKCK : 575
IPD050Fi  : TIGQLIDAPEMQEMPSNADWLIFVNEVEAVAAQMPEEVFGSVAVWKAKCR : 555
IPD050Fj  : NLGQLVETPEMPDMPSNADWLIFVNEVEAVAEQMPAEVVGSVAVWKAKCR : 588
IPD050Fp  : EINKMVEAPEMPSMPSTHEWDIFENEIEEVAESMPEEVT-EARTWRTKCR : 547
IPD050Gd  : ELEDIIHAPELPIIS-SYTWDILENDIDELAALMPSEVS-EVVTWKAKCR : 587
IPD050Ga  : ELEDIIHAPELPLIP-PYTWDIMENDIEEFAALMPSEVS-EVVTWKAKCR : 585
IPD050Gb  : ELEDIVHAPELPLIP-PYTWDILENDIEEFAALMPLEVS-EVVTWKAKCR : 585
IPD050Gc  : ELEDIIHAPELPIIL-PYTWDILENDIEEFAALMPSEVS-EVVTWKAKCR : 585
IPD050Fb  : HHHHCCCCCCCCCCCHHHHHHHHHHHHHHHHCCCCCCH-HHHHHHHHHH : 556
IPD050Fs  : HHCCCCCCCCCCCCCHHHHHHHHHHHHHHHHCCCCCH-HHHHHHHHHH : 563
IPD050Fo  : HHCCCCCCCCCCCCCHHHHHHHHHHHHHHHHCCCCCH-HHHHHHHHHH : 606
IPD050Fk  : HHCCCCCCCCCCCCCHHHHHHHHHHHHHHHHCCCCCCH-HHHHHHHHHH : 602
IPD050Fe  : HHCCCCCCCCCCCCCHHHHHHHHHHHHHHHHCCCCCCC-CHHHHHHHHH : 554
IPD050Fl  : HHCCCCCCCCCCCCCHHHHHHHHHHHHHHHHCCCHHH-HHHHHHHHHH : 555
IPD050Fn  : HHCCCCCCCCCCCCCHHHHHHHHHHHHHHHHCCCCHHH-HHHHHHHHHH : 557
IPD050Ft  : HHHHCCCCCCCCCCCCHHHHHHHHHHHHHHHHCCCCCCH-HHHHHHHHHH : 588
IPD050Fh  : HHHHHCCCCCCCCCCCHHHHHHHHHHHHHHHHCCCCCCCC-HHHHHHHHH : 609
IPD050Fg  : HHHHHCCCCCCCCCCCHHHHHHHHHHHHHHHHCCCCCCCC-HHHHHHHHH : 608
IPD050Fm  : HCCCCCCCCCCCCCCCHHHHHHHHHHHHHHHHHHCCCCCCH-HHHHHHHHH : 603
IPD050Fd  : HCCCCCCCCCCCCCCHHHHHHHHHHHHHHHHCCCCHHH-HHHHHHHHH : 597
IPD050Fr  : HHCCCCCCCCCCCCCHHHHHHHHHHHHHHHHCCCCCCH-HHHHHHHHH : 599
IPD050Bb  : HHCCCCCCCCCCCCCHHHHHHHHHHHHHHHHCCCCHHH-HHHHHHHHH : 510
IPD050Bd  : HHHHCCCCCCCCCCCHHHHHHHHHHHHHHHHCCCCCCC-CHHHHHHHH : 510
IPD050Aa  : HHHHCCCCCCCCCCCHHHHHHHHHHHHHHHHCCCCCCC-CHHHHHHHH : 511
IPD050Ba  : HHHHCCCCCCCCCCCHHHHHHHHHHHHHHHHCCCCCCC-CHHHHHHHH : 511
IPD050Bc  : HHHHCCCCCCCCCCCHHHHHHHHHHHHHHHHCCCCCCC-CHHHHHHHH : 510
IPD050Fa  : HHHHHCCCCCCCCCCCHHHHHHHHHHHHHHHHCCCCCCCC-CHHHHHHHH : 571
IPD050Ff  : HCCCCCCCCCCCCCCHHHHHHHHHHHHHHHHCCCCCCCC-CHHHHHHHH : 578
IPD050Fq  : HHHHHHCCCCCCCCCHHHHHHHHHHHHHHHHCCCCCCCC-CCHHHHHHH : 575
IPD050Fi  : HCCCCCCCHHCCCCHHHHHHHHHHHHHHHHCCCCCCCCCCHHHHHHHH : 555
IPD050Fj  : HCCCCCCCCCCCCCCHHHHHHHHHHHHHHHHCCCCCCCCCHHHHHHHHH : 588
IPD050Fp  : HHHHCCCCCCCCCCCCCHHHHHHHHHHHHHCCCHHHH-HHHHHHHHHH : 547
IPD050Gd  : HHCCCCCCCCCCCCC-CCHHHHHHHHHHHHHCCCCCCH-HHHHHHHHH : 587
IPD050Ga  : HHHHHHCCCCCCCCC-CCCCHHCCCHHHHHHCCCCHH-HHHHHHHHHH : 585
IPD050Gb  : HHHHCCCCCCCCCCC-CCCHHHHHHHHHHHHHCCCCHH-HHHHHHHHH : 585
IPD050Gc  : HHHHHCCCCCCCCCC-CCHHHHHHHHHHHHHCCCCCCH-HHHHHHHHH : 585
                                     helix 6
```

Fig. 16o

```
            ------------- Motif 1 --------------------][-----
                  *         720         *         740         *
IPD050Fb : NVAAVGRELMTTTAYMSQLQYDIQVQAMLQGIASKQADRLSSIQAADLSS : 606
IPD050Fs : NVAAVGRELMTTTAYMSQLQYDIQVQAMLQDIASKQADRLSSIQAADLSS : 613
IPD050Fo : NVAAVGRELMTTTAYMSQLQYDIQVQAMLQDIASKQADRLSSTQAADLSS : 656
IPD050Fk : NVAVVGRELTTTSAYMSQLQYDVQVQAMLQDIARKQADRLSSIQAVDLSS : 652
IPD050Fe : NVAAVGRELMTTSAYISQLQYDIKVQALLQDIANRQADRLSSIQAADLTS : 604
IPD050Fl : NVAAVGRELTTTSAYISQLQYDIKVQAMLQDIANKQADRLSSIQAADLSS : 605
IPD050Fn : NVAAVGRELTTTSAYISQLQYDIKVQAMLQDIASRQADRLLSIQAADLSS : 607
IPD050Ft : NVAVLGREMITTATYISELQYDIKVQGMLQEIATSHANRLSSIQATDLSN : 638
IPD050Fh : NVAVLGREMITLATYISQLQYDIQMQDMLQQIARKQADRLSAIQLSIPNT : 659
IPD050Fg : NVAVLGQEMTTTAAYISQLQYDIMMQDMLQQIARRQADRLSAIQLPDLTN : 658
IPD050Fm : NVAVLGREMTTLAAYISQLQYDINMQHMLQQIARKQADRLSAIELPDLRN : 653
IPD050Fd : NVAVLGREMTTLAAYISQLQYDIEMQHMLQQIARKQADRLSAIQLPDLRN : 647
IPD050Fr : NVAVLGREMTTLAAYISQLQYDIQMQHMLQQIARKQVDRLSAIQLPDLKN : 649
IPD050Bb : NVAALGREMSTMAAHIAELQYQIQVQEMLREIAQKQADRLSSISPADLTN : 560
IPD050Bd : NVAALGREMSTMAAHISELQFEIKVQEMLREIAQKQADRLSSIKPADLTN : 560
IPD050Aa : NVAALGREMSTMAAHIAELQFEIQVQEMLREIAKKQADRLSSIKPADLTN : 561
IPD050Ba : NVAALGREMSTTAAHIAELQYEIQVQGMLQQIAKKQADRLSSIKPADLTN : 561
IPD050Bc : NVAALGREMSTTAVHISELQYEIQVQGMLQEIAKKQAERLSSIKPADLTN : 560
IPD050Fa : NVAVLGQEMCTTGSHIADLQYQIKVEEMLREIAQSQAERLEGISSADLSS : 621
IPD050Ff : NVAVLGQAMCTTAAYISELQYQITVEEMLQEIAQRQADRLVGISAADLSS : 628
IPD050Fq : NVAVLGQAMCTTAAYMSELQYQITVEEMLQEIAQRQADRLVGISAADLSS : 625
IPD050Fi : NVAVLGQEMCTMAAHIAELQQQIKLEELLQEIADRQADRLLGISAADLSS : 605
IPD050Fj : NVAVLGQEMCTTAAHIGELTYQIKVEEMLQEIAQRQANRLESLTPANLSS : 638
IPD050Fp : NVAAVCRAISTTASYIGQLQYELFVHSNQELIARRQAERLEAIQPADLTN : 597
IPD050Gd : NLVAVCREICIAANFAAEVQYELFVHARQQEMARRQAERLEGMQLATDLS : 637
IPD050Ga : NLVAVCREICIAASFACEVQYELFVHARQQEMARRQAERLEGMQIAADLS : 635
IPD050Gb : NLVAVCREICIAASFACEVQYELFVHARQQEMARRQAERLEGMQTAADLS : 635
IPD050Gc : NLVAVCREICIAASFACEVQYELFVHARQQEMARRQAERLEGMQTAADLS : 635
IPD050Fb : HHHHHHHHHHHHHHHHHHHHHHHHHHHHHHHHHHHHHHHHHHHHCCCCH : 606
IPD050Fs : HHHHHHHHHHHHHHHHHHHHHHHHHHHHHHHHHHHHHHHHHHHHCCCHH : 613
IPD050Fo : HHHHHHHHHHHHHHHHHHHHHHHHHHHHHHHHHHHHHHHHHHHHCCCHH : 656
IPD050Fk : HHHHHHHHHHHHHHHHHHHHHHHHHHHHHHHHHHHHHHHHHHHHCCCCC : 652
IPD050Fe : HHHHHHHHHHHHHHHHHHHHHHHHHHHHHHHHHHHHHHHHHHHHCCCCC : 604
IPD050Fl : HHHHHHHHHHHHHHHHHHHHHHHHHHHHHHHHHHHHHHHHHHHHCCCC : 605
IPD050Fn : HHHHHHHHHHHHHHHHHHHHHHHHHHHHHHHHHHHHHHHHHHHHHHH : 607
IPD050Ft : HHHHHHHHHHHHHHHHHHHHHHHHHHHHHHHHHHHHHHHHHHHHCCCCC : 638
IPD050Fh : HHHHHHHHHHHHHHHHHHHHHHHHHHHHHHHHHHHHHHHHHHHHCCCCC : 659
IPD050Fg : HHHHHHHHHHHHHHHHHHHHHHHHHHHHHHHHHHHHHHHHHHCCCCCCCH : 658
IPD050Fm : HHHHHHHHHHHHHHHHHHHHHHHHHHHHHHHHHHHHHHHHHCCCCCCCC : 653
IPD050Fd : HHHHHHHHHHHHHHHHHHHHHHHHHHHHHHHHHHHHHHHHHCCCCCCCC : 647
IPD050Fr : HHHHHHHHHHHHHHHHHHHHHHHHHHHHHHHHHHHHHHHHHCCCCCCCC : 649
IPD050Bb : HHHHHHHHHHHHHHHHHHHHHHHHHHHHHHHHHHHHHHHHHCCCCCCCC : 560
IPD050Bd : HHHHHHHHHHHHHHHHHHHHHHHHHHHHHHHHHHHHHHHHHCCCCCCHH : 560
IPD050Aa : HHHHHHHHHHHHHHHHHHHHHHHHHHHHHHHHHHHHHHHHHCCCCCCCC : 561
IPD050Ba : HHHHHHHHHHHHHHHHHHHHHHHHHHHHHHHHHHHHHHHHHCCCCCCCC : 561
IPD050Bc : HHHHHHHHHHHHHHHHHHHHHHHHHHHHHHHHHHHHHHHHHCCCCCCHH : 560
IPD050Fa : HHHHHHHHHHHHHHHHHHHHHHHHHHHHHHHHHHHHHHHHHHHCCCC : 621
IPD050Ff : HHHHHHHHHHHHHHHHHHHHHHHHHHHHHHHHHHHHHHHHHHHCHHH : 628
IPD050Fq : HHHHHHHHHHHHHHHHHHHHHHHHHHHHHHHHHHHHHHHHHHHCCCCH : 625
IPD050Fi : HHHHHHHHHHHHHHHHHHHHHHHHHHHHHHHHHHHHHHHHHHHHCCCC : 605
IPD050Fj : HHHHHHHHHHHHHHHHHHHHHHHHHHHHHHHHHHHHHHHHHHHCCCCCCC : 638
IPD050Fp : HHHHHHHHHHHHHHHHHHHHHHHHHHHHHHHHHHHHHHHHHCCCCCCCC : 597
IPD050Gd : HHHHHHHHHHHHHHHHHHHHHHHHHHHHHHHHHHHHHHHHHHHHHCCCC : 637
IPD050Ga : HHHHHHHHHHHHHHHHHHHHHHHHHHHHHHHHHHHHHHHHHHHHHCCHH : 635
IPD050Gb : HHHHHHHHHHHHHHHHHHHHHHHHHHHHHHHHHHHHHHHHHHHHHCCCC : 635
IPD050Gc : HHHHHHHHHHHHHHHHHHHHHHHHHHHHHHHHHHHHHHHHHHHHHCCCC : 635
                              helix 7
```

Fig. 16p

```
            ---------------- Motif 4 --------------]     [---
                    760          *         780         *        800
IPD050Fb  :  -FTEMVTEMDMRTTRLLVELIKVLHMQSVALMYQSLTLP-ELMNAWPVTM  :  654
IPD050Fs  :  -FTEMVTQMDMRTTRLLVELIKVLNMQNVALMYQSLTMP-EPMNGWPVTM  :  661
IPD050Fo  :  -FTEMVTQMDMRTIRLQVELIKVLDVQNVALMYQSLVKP-ELMNAWPVTM  :  704
IPD050Fk  :  -FTEMVTQMDMRTTRLLVELIKVLDMQNVALMYQSLIMP-EPINAWPVTM  :  700
IPD050Fe  :  -YTEMVTQMDMRTTRLLMELIKVLDMQNVALMYQFLTPP-TPMNAWPVTM  :  652
IPD050Fl  :  -YTEMVTQMDMRTTRLLMELIKVLDMQNAALMYQFLTLP-APMNAWPVTM  :  653
IPD050Fn  :  -YTEMVTQMDMRTTRLLMELIKVLDMQNAALMYQFLSLP-APMNAWPVTM  :  655
IPD050Ft  :  -YTEMVTQMDMRTTRMLVALINVVHMQNAALMYQCLSPP-TYVNAWPVTM  :  686
IPD050Fh  :  GYTEMLMQMDMRTTRLLVALIRAVHIQNAALMYQYLSEP-IPVSAWPVNM  :  708
IPD050Fg  :  -FTEMVIQMDMRTTRILVALIKVMYIQNAALMYQYLSEP-TPVSAWPVNM  :  706
IPD050Fm  :  -YGELVTQMDMRTTRLLVALIKVVNIQNAALMYQYLSEP-TPVYAWPVNM  :  701
IPD050Fd  :  -YAELVTQMDMRTTRLLVALIKVVNIQNAALMYQYLSEP-TPVYAWPVNM  :  695
IPD050Fr  :  -YAELVTQMDMRTTRLLVALIKVVNIQNAALMYQYLSEP-TPVYAWPVSM  :  697
IPD050Bb  :  -YLEMVSQMDMRTTRMLLELIRVLYIQNAALQYEYLQTP-APLNAWPVAM  :  608
IPD050Bd  :  -YLEMVSEMDMRTTRMLLELIKVLYIQNAALQYEYLQTP-ARLNAWPVTM  :  608
IPD050Aa  :  -YLEMVSEMDMRTTRMLLELIRVLYIQNAALQYEYLQTP-APLNAWPVTM  :  609
IPD050Ba  :  -YFEMVSEMDMRTTRMLLELIQVLNIQNGALRYEYLQPA-APLNAWPVTM  :  609
IPD050Bc  :  -YLEMVSEMDMRTTRMLVELIRVLNIQNGALRYEYLQPA-APLNAWPVTM  :  608
IPD050Fa  :  -YTEMVSQIDMRTTRLLFQLIKVLHIQNAALKYEYLYAADEHLVSWPVSM  :  670
IPD050Ff  :  -YTEMASQIDMRTTRILLELIKMLYIQNAAIKYEYLYDANEKLNSWPVSM  :  677
IPD050Fq  :  -YTEMASQIDMRTTRILLELIKMLYIQNAAIKYEYLYDANEKLNSWPVSM  :  674
IPD050Fi  :  -FTEMLTQIDMRTTRLLLQLIKLLHIQNVAINYEYLFPANGRLSSWPVTM  :  654
IPD050Fj  :  -YTEMLSEIDMRTTRLLLQLIRLLHIQNAAIKYEYLYAAGEQLNSWPVSM  :  687
IPD050Fp  :  -SLEMATQLDMRTSRMLLNLLKVLTLQSGALQFHFLLPP-TPFTGW-VNM  :  644
IPD050Gd  :  SYIELATQADMRTTRLLLSLLNVLADHQGALHYHYLMELQVFTFTWPSVD  :  687
IPD050Ga  :  SYIELATQADMRTTRLLLSLLNVLAGHQGALHYHYLMELEVFTFSWPSVD  :  685
IPD050Gb  :  SYIELATQADMRTARLLLSLLNVLAGHQGALHYHYLMELEVFTSSWPTVD  :  685
IPD050Gc  :  SFIELATQADMRTTRLLLSLLNVLAGHQGALHYHYLMELEVFTSSWPSVD  :  685
IPD050Fb  :  -HHHHHHHHHHHHHHHHHHHHHHHHHHHHHHHHCCCCC-CCCCCCCCCH  :  654
IPD050Fs  :  -HHHHHHHHHHHHHHHHHHHHHHHHHHHHHHHHCCCCCC-CCCCCCCCCH  :  661
IPD050Fo  :  -HHHHHHHHHHHHHHHHHHHHHHHHHHHHHHHHCCCCCC-CCCCCCCCCH  :  704
IPD050Fk  :  -HHHHHHHHHHHHHHHHHHHHHHHHHHHHHHHHCCCCCC-CCCCCCCCCH  :  700
IPD050Fe  :  -HHHHHHHHHHHHHHHHHHHHHHHHHHHHHHHHCCCCC-CCCCCCHHHH  :  652
IPD050Fl  :  -HHHHHHHHHHHHHHHHHHHHHHHHHHHHHHHHCCCCC-CCCCCCCCCH  :  653
IPD050Fn  :  -HHHHHHHHHHHHHHHHHHHHHHHHHHHHHHHHCCCCC-CCCCCCCCCH  :  655
IPD050Ft  :  -HHHHHHHHHHHHHHHHHHHHHHHHHHHHHHHHHCCCCCCC-CCCCCCCCCH  :  686
IPD050Fh  :  CHHHHHHHHHHHHHHHHHHHHHHHHHHHHHHHHCCCCC-CCCCCCCCCH  :  708
IPD050Fg  :  -HHHHHHHHHHHHHHHHHHHHHHHHHHHHHHHHCCCCC-CCCCCCCCCH  :  706
IPD050Fm  :  -HHHHHHHHHHHHHHHHHHHHHHHHHHHHHHHHCCCCC-CCCCCCCCCH  :  701
IPD050Fd  :  -HHHHHHHHHHHHHHHHHHHHHHHHHHHHHHHHCCCCC-CCCCCCCCCH  :  695
IPD050Fr  :  -HHHHHHHHHHHHHHHHHHHHHHHHHHHHHHHHCCCCC-CCCCCCCCCH  :  697
IPD050Bb  :  -HHHHHHHHHHHHHHHHHHHHHHHHHHHHHHHCCCC-CCCCCCHHHH  :  608
IPD050Bd  :  -HHHHHHHHHHHHHHHHHHHHHHHHHHHHHHHHCCCC-CCCCCCCCCH  :  608
IPD050Aa  :  -HHHHHHHHHHHHHHHHHHHHHHHHHHHHHHHHCCCCC-CCCCCCCCCH  :  609
IPD050Ba  :  -HHHHHHHHHHHHHHHHHHHHHHHHHHHHHHHHCCCCC-CCCCCCCCCH  :  609
IPD050Bc  :  -HHHHHHHHHHHHHHHHHHHHHHHHHHHHHHHHCCCCCCC-CCCCCCCCCH  :  608
IPD050Fa  :  -HHHHHHHHHHHHHHHHHHHHHHHHHHHHHHHHHCCCCCCCCCCCCHH  :  670
IPD050Ff  :  -HHHHHHHHHHHHHHHHHHHHHHHHHHHHHHHHHCCCCCCCCCCCCCCH  :  677
IPD050Fq  :  -HHHHHHHHHHHHHHHHHHHHHHHHHHHHHHHHCCCCCCCCCCCCHHH  :  674
IPD050Fi  :  -HHHHHHHHHHHHHHHHHHHHHHHHHHHHHHHHCCCCCCCCCCCCCCH  :  654
IPD050Fj  :  -HHHHHHHHHHHHHHHHHHHHHHHHHHHHHHHHHCCCCCCCCCCCCCCH  :  687
IPD050Fp  :  -HHHHHHHHHHHHHHHHHHHHHHHHHHHHHHHHCCCCC-CCCCCC-CCH  :  644
IPD050Gd  :  HHHHHHHHHHHHHHHHHHHHHHHHHHHHHHHHHCCCCCCCCCCCCCCHH  :  687
IPD050Ga  :  HHHHHHHHHHHHHHHHHHHHHHHHHHHHHHHHHCCCCCCCCCCCCCCCHH  :  685
IPD050Gb  :  HHHHHHHHHHHHHHHHHHHHHHHHHHHHHHHHHCCCCCCCCCCCCCCCHH  :  685
IPD050Gc  :  HHHHHHHHHHHHHHHHHHHHHHHHHHHHHHHHHCCCCCCCCCCCCCCCHH  :  685
                              helix 8
```

Fig. 16q

```
           ------------ Motif 7 ------------------------][
              *         820         *         840         *
IPD050Fb : ETVWRMLIQHEHAAVLGLIRLGPSF----DFRKTLTVKDIPVDLLLHGED : 700
IPD050Fs : ETVWRMLIQHEHAAVLGLMRLGPSF----DFRKTLTVKDIPVDLLLHGED : 707
IPD050Fo : DMVWRLLIQHEHAAVLGLMRLGPSF----DFRKTLTVKDIPVDLLLHGED : 750
IPD050Fk : ETVWGLLIQHEHAAVLGLIRLGPSF----DFRRTFTVKDIPVDLLLHGED : 746
IPD050Fe : ETVWGMLVQHEHAAVLGLMRLGPAF----DFKRTFIVKEIPVDLLLHGED : 698
IPD050Fl : ETVWGMLVQHEHAAVLGLMRLGPAF----DFRRTFIVKEIPVDLLLHGED : 699
IPD050Fn : ETVWGMLVQHEHAAVLGLMRLGPAF----DFRRTFVVKEIPVDLLLHGED : 701
IPD050Ft : ETVWSMLVQHEHAAVLGLMRLGPSF----DFMRTYVVEGIPVQLLLDGED : 732
IPD050Fh : DAVWRILVQHEQSAIQGLLRLGPAF----DIERVFVVEDIPVSLLLEGDD : 754
IPD050Fg : DTVWRMLVQHEQLAIQGLLRLGPAF----DIVRTFVVKSIPVRLLLDGDD : 752
IPD050Fm : DSVWRMLVQHEQFAIQGLMRLGPAF----DIVRTYEVKGIPVSLLLDGDD : 747
IPD050Fd : DSVWRMLVQHEQFAIQGLMRLGPAF----DIVRTYVVKSIPVSLLLDGDD : 741
IPD050Fr : DSVWRMLVQHEQFAVQGLMRLGPAF----DIVRAYVVKSIPVSLLLEGDD : 743
IPD050Bb : QTVWGLLIQQETTAITGLLQLGAPS----DFTQEYVVKDIPVSLLLEGRD : 654
IPD050Bd : QTVWTLLVQQETTAITGLLQLGAPS----DYTQGYVVENIPVSLLLEGRD : 654
IPD050Aa : QTVWGLLVQQETAAINGLLQMGAPS----DYTQEYAVRDVPVRLLLGGGD : 655
IPD050Ba : QTVWGLLVQQEAAAINGLLQLGAPS----DFTREYVVGDIPVKLLLGGGD : 655
IPD050Bc : QTVWGLLVQQETAAINGLLQLGAPS----DYTREYVVRDIPVRLLLGGGD : 654
IPD050Fa : ETVWTMLLQQQRLSLLGWENLVGTNNLPNDDTRTYVVKDIPVEVLLSGRD : 720
IPD050Ff : ETVWTMLLQQENAALLGLLDLGPTN----DFTVTYAVKDIPTKLLVDGFD : 723
IPD050Fq : ETVWTMLLRQENAALLGLLNLGPSN----DFTVTYAVKDIPVKLLVDGYD : 720
IPD050Fi : HTVWEMLLQQESSAITGLLALGPST----DFARTFVVHDIPVGLLVDGFD : 700
IPD050Fj : DTVWSMLLQQENSALVGLLDLGPSN----DFTRSFVIQGIPIGLLVDGND : 733
IPD050Fp : GMVRNALVKHEADAVAAQERLGPST----DYVRTYVMSGIPVSLLLDGDD : 690
IPD050Gd : SVRMHLLRLNQWARARENMLFGPGVLT-VEVQQDYVVDAIPMSLLLSGED : 736
IPD050Ga : SVRMHLLQLNQRARARESGLFGNGVLT-VDLEHNYVLDAIPVSLLLSGED : 734
IPD050Gb : SVRTHLLQLNQRARARENALFGDGVLT-VDLQHDYVLDAIPVSLLLSGED : 734
IPD050Gc : GVRMHLLQLNQRARARENALFGDGVLT-VDLQHDYVLDAIPVSLLLSGED : 734
IPD050Fb : HHHHHHHHHHHHHHHHHCCCCCCCC----CCCCCCCCCCCCHHHHCCCCC : 700
IPD050Fs : HHHHHHHHHHHHHHHHHCCCCCCCC----CCCCCCCCCCCCCCCCCCCCC : 707
IPD050Fo : HHHHHHHHHHHHHHHHHHCCCCCC----CCCCCCCCCCCCCCCCCCCCCC : 750
IPD050Fk : HHHHHHHHHHHHHHHHHHCCCCCC----CCCCCCCCCCCCCCCCCCCCCC : 746
IPD050Fe : HHHHHHHHHHHHHHHHHHCCCCCC----CCCCCCCCCCCCCCCCCCCCCC : 698
IPD050Fl : HHHHHHHHHHHHHHHHHHCCCCCCC----CCCCCCCCCCCCCCCCCCCCC : 699
IPD050Fn : HHHHHHHHHHHHHHHHHHCCCCCCC----CCCCCCCCCCCCCCCCCCCCC : 701
IPD050Ft : HHHHHHHHHHHHHHHHHHCCCCCC----CCCCCCCCCCCCCCCCCCCCCC : 732
IPD050Fh : HHHHHHHHHHHHHHHHHHCCCCCCC----CCCCCCCCCCCCCCCCCCCCC : 754
IPD050Fg : HHHHHHHHHHHHHHHHHHCCCCCCC----CCCCCCCCCCCCCCCCCCCCC : 752
IPD050Fm : HHHHHHHHHHHHHHHHHHCCCCCCC----CCCCCCCCCCCCCCCCCCCCC : 747
IPD050Fd : HHHHHHHHHHHHHHHHHHCCCCCCC----CCCCCCCCCCCCCCCCCCCCC : 741
IPD050Fr : HHHHHHHHHHHHHHHHHHCCCCCCC----CCCCCCCCCCCCCCCCCCCCC : 743
IPD050Bb : HHHHHHHHHHHHHHHHHHCCCCCCC----CCCCCCCCCCCCCCCCCCCCC : 654
IPD050Bd : HHHHHHHHHHHHHHHHHHCCCCCCC----CCCCCCCCCCCCCCCCCCCCC : 654
IPD050Aa : HHHHHHHHHHHHHHHHHHCCCCCCC----CCCCCCCCCCCCCCCCCCCCC : 655
IPD050Ba : HHHHHHHHHHHHHHHHHHCCCCCCC----CCCCCCCCCCCCHHHHCCCCC : 655
IPD050Bc : HHHHHHHHHHHHHHHHHHCCCCCCC----CCCCCCCCCCCHHHHCCCCCC : 654
IPD050Fa : HHHHHHHHHHHHHHHHHHCCCCCCCCCCC CCCCCCCCCCCCCCCCCCCC : 720
IPD050Ff : HHHHHHHHHHHHHHHHHHCCCCCCCC----CC CCCCCCCCCCCCCCCCCC : 723
IPD050Fq : HHHHHHHHHHHHHHHHHHCCCCCCC----CCC CCCCCCCCCCCCCCCCCC : 720
IPD050Fi : HHHHHHHHHHHHHHHHHHCCCCCCCC----CCCCC CCCCCCCCCCCCCCC : 700
IPD050Fj : HHHHHHHHHHHHHHHHHHCCCCCCCC----CCCCC CCCCCCCCCCCCCCC : 733
IPD050Fp : HHHHHHHHHHHHHHHHHHCCCCCC----CCCCC CCCCCCCCCCCCCCCCC : 690
IPD050Gd : HHHHHHHHHHHHHHHHHHCCCCCCCCC-CCCCCCCCCCCCCCCCCCCCCC : 736
IPD050Ga : HHHHHHHHHHHHHHHHHHCCCCCCCCC-CCCCCCCCCCCCCCCCCCCCCC : 734
IPD050Gb : HHHHHHHHHHHHHHHHHHCCCCCCCC-CCCCCCCCCCCCCCCCCCCCCCC : 734
IPD050Gc : HHHHHHHHHHHHHHHHHHCCCCCCCC-CCCCCCCCCCCCCCCCCCCCCCC : 734
                          helix 9
```

Fig. 16r

```
         Motif 22 -][------ motif 10 ------]              [--
              860        *         880         *         900
IPD050Fb : WEFEISVDD-FTVFPRTWSRVRIHHLEMKFVGSGDEAAPGGGMQGAHQPA : 749
IPD050Fs : WEFEISVDD-FTAFPATWSRVRIHHLEMKFVGS-EEAAPWG-MQGPHQPA : 754
IPD050Fo : WEFEIPVDD-FRVFPATWSRVRIHHLEMKFAAA-----PAG-TQGAHQPA : 793
IPD050Fk : WEFEIPVDD-FTVFPVTWSRVRIHHLEMKFVGT-DEAAPAPGLQGTHQPT : 794
IPD050Fe : WQFEIPVNE-RTVFPSTWSQVRIHHLEMKFVGSNN-IDHEG----SHQPI : 742
IPD050Fl : WQFEIPVNE-LTVFPGTWSQVRIHHLEMKFVGTAEGSAPNG----AHLPI : 744
IPD050Fn : WQFEIPVNE-LTVFPGTWSQVRIHHLEMKFVGTAEGSAPNG----AHQPI : 746
IPD050Ft : WEFEISVED-YTTFPSTWSRVRIHHLEMKFVQAAD----------VHQPI : 771
IPD050Fh : YEFDIPVED-NITFPLSLSRVRIHHLEMKFVAS------GGQ-KQVHMPV : 796
IPD050Fg : YQFEIPVED-PLTFPLSLSRVRIHHLEMKIVQG----------AHVHTPI : 791
IPD050Fm : YEFEIPAQD-HVTFPLSLSRVRIHHLEMKFVQ------GEG--DQLHMPV : 788
IPD050Fd : YEFEIPVEN-HITFPLSLSRVRIHHLEMRFVQ--DGDTAQG--AHVHMPI : 786
IPD050Fr : YEFELPVED-HITFPLSLSRVRIHHLEMKFVQGAAGGSDQGT-QIVHMPI : 791
IPD050Bb : WEFELPVLN--ADFPSTWSRVRIHHVDMQFD---------AAATSIHIPT : 693
IPD050Bd : WEFELPVMN--ADFPTTWCRVRIHHVEMQFD---------AGAK--HLPS : 691
IPD050Aa : WEFELPVRN--ADFPLTWCRVRIRYVDMQFD---------AAAE--HLPV : 692
IPD050Ba : WEFELPVTD--ADFPLTWCRVRIQHVDMQFD---------AAAE--HLPT : 692
IPD050Bc : WEFELPVTD--DDFPLTWCRVRIHYVDMQFD---------AAAE--HLPT : 691
IPD050Fa : WPFVIHEED-YTAFPSGWYYVRINHVELKFEQQ----TAGSTDIVIHQPS : 765
IPD050Ff : WNFEIAVED-FAIFPSGLSRVRIRYVELKFDQQ----GADSSNIVIHQPS : 768
IPD050Fq : WNFEIAVED-FSIFPSGWSRVRIRYVELKFDQQ----GTDSSNIVIHQPS : 765
IPD050Fi : WQFAIPVMDDSSAFPIGFSRVRIRHVELKFSAI----DIDAS-ATVHQPR : 745
IPD050Fj : WQFSIPVED-SPTFPIGYSRVRIRYVELRFDQG----TSDEG-RMIHQPS : 777
IPD050Fp : WIFTINPLD-GSTFPLSWSRVRIRYLEMKFTGG---------EEFHKPT : 729
IPD050Gd : WSFTINPGQNASVFPAPWDYVRIRYVEMKFTG------------EHHPV : 773
IPD050Ga : YNFTINPERNASSFPTPWDYVRIRYVEVKFTG------------EHQPV : 771
IPD050Gb : WNFTINPERNASSFPTPWDYVRIRYVEMRFTG------------EHLPV : 771
IPD050Gc : WSFTINPERNASAFPTPWDYVRIRYVEMKFTG------------EHLPV : 771
IPD050Fb : CCCC-CCCCCCCCCCCCCCCCCCCCCCCCCCCCCC : 749
IPD050Fs : CCCC-CCCCCCCCCCCCCC-CCCCCCC-CCCCCCC : 754
IPD050Fo : CCCC-CCCCCCCCCCCCCC-----CCC-CCCCCCC : 793
IPD050Fk : CCCC-CCCCCCCCCCCCCC-CCCCCCCCCCCCCCC : 794
IPD050Fe : CCCC-CCCCCCCCCCCCCC-CCCCC----CCCCC  : 742
IPD050Fl : CCCC-CCCCCCCCCCCCCC-CCCCCCCC----CC  : 744
IPD050Fn : CCCC-CCCCCCCCCCCCCC-CCCCCCCC----CCCC : 746
IPD050Ft : CCCC-CCCCCCCCCCCCCCC----------CCCCC : 771
IPD050Fh : CCCCC-CCCCCCCCCCCCC-------CCC-CCCCCCC : 796
IPD050Fg : CCCC-CCCCCCCCCCCCCC-----------CCCCCCC : 791
IPD050Fm : CCCC-CCCCCCCCCCCCCC------CCC--CCCCCCC : 788
IPD050Fd : CCCC-CCCCCCCCCCCCCC--CCCCCCC--CCC    : 786
IPD050Fr : CCCC-CCCCCCCCCCCCCCCCC-CCCCCCCCCC-CCC : 791
IPD050Bb : CCCC--CCCCCCCCCCCCC---------CCCCCCCCCC : 693
IPD050Bd : CCCC--CCCCCCCCCCCCC---------CCCC--CCCC : 691
IPD050Aa : CCCC--CCCCCCCCCCCCC---------CCCC--CCCC : 692
IPD050Ba : CCCC--CCCCCCCCCCCCC---------CCCC--CCCC : 692
IPD050Bc : CCCC--CCCCCCCCCCCCC---------CCCC--CCCC : 691
IPD050Fa : CCCC-CCCCCCCCCCCCCCC----CCCCCCCCCCCC : 765
IPD050Ff : CCCC-CCCCCCCCCCCCCCCC----CCCCCCCCCCCC : 768
IPD050Fq : CCCC-CCCCCCCCCCCCCCCC----CCCCCCCCCCCC : 765
IPD050Fi : CCCCCCCCCCCCCCCCCCCC----CCCC-CCCCCCC : 745
IPD050Fj : CCCC-CCCCCCCCCCCCCCCC----CCCCC-CCCC  : 777
IPD050Fp : CCCC-CCCCCCCCCCCCCC-----------CCCCCCC : 729
IPD050Gd : CCCC-CCCCCCCCCCCCCCCCCC------------CCCCC : 773
IPD050Ga : CCCCCCCCCCCCCCCCCCCCCCCC------------CCCCC : 771
IPD050Gb : CCCCCCCCCCCCCCCCCCCCCCCC------------CCCCC : 771
IPD050Gc : CCCCCCCCCCCCCCCCCCCCCCCC------------CCCCC : 771
              β1                β2
```

Fig. 16s

```
         - Motif 17 ---][-------------- motif 3 -----------
                  *         920          *        940           *
IPD050Fb : TKTGEVYILLQSSRVFHDRNKT--KPLHYEAGIPLDYHYAYNLETGETTL : 797
IPD050Fs : TKSGEIYILLQSSRVFHDRNKT--KPLHYEAGIPLDYHYAYNLGTGETTL : 802
IPD050Fo : TKSGEIYILLQSSRVFHDRNKA--EPLHYEAGVPLDYHYAYNLETGETTL : 841
IPD050Fk : TKTGEIYILLQSSRVFHDRNNT--KPLHYEAGVPLDYHYAYNLETGETTL : 842
IPD050Fe : TESGEVYILLQSSRVFHDRNKS--ELLHYEAAVPLDYHYAYHLETGETTL : 790
IPD050Fl : TESGEVYILLQSSRVFHDRNKT--EPLHYEAAVPLDYHYAYHLKTGETTL : 792
IPD050Fn : TESGEVYILLQSSRVFHDRNKT--EPLHYEAAVPLDYHYAYHLKTGETTL : 794
IPD050Ft : TDTGKVYMLLQGSRIFRDRNRA--DAIRYEAAMSLDYHYAYRLDTGETTL : 819
IPD050Fh : TDSGSVYILLQSSRNFHDRNER--AVVHYEAATSLDYHYAYNLETGQIKV : 844
IPD050Fg : TATGKIYILLQGSRNFHDRNEG--KIMHYEAATALDYQYAYQLDTGETTV : 839
IPD050Fm : TDTGSVYILLQGSRNFHDRSEG--TILHYEAATSLDYHFAYRLDTGETTV : 836
IPD050Fd : TDTGSIYILLQGSRNFRDRNEG--AILHYEAATPLDYHFAYRLDTGETTV : 834
IPD050Fr : TDTGSIYILLQGSRNFHDRNES--AILHYEAATSLDYHFAYRLDTGASTV : 839
IPD050Bb : TNTGVVYLLLQSSRFFDDRARRANEFISYEAGTGLFYQYAYRLATGEATV : 743
IPD050Bd : TSTGQVYMLLQSSRFFADRAKRANEYINYQAGTGLYYQYAYRLATGEATV : 741
IPD050Aa : TSTGEVYMLLQSSRFFEDRAKRENEFISYEGGMGLQYQYAYRLATGDATV : 742
IPD050Ba : TSTGEVYMLLQSSRFFEDRAQHEDEFISYEAGTGLQYQYAYRLATGEATV : 742
IPD050Bc : TSTGEVYMLLQSSRFFDDRAKHEDEFVSYEAGTGLQYQYAYRLDTGEATV : 741
IPD050Fa : TNTGRLYMLLQSSRFFHDRNQG--VKMEYEGSRGLSYPYAYNLNTGETTH : 813
IPD050Ff : TNTGLVYMLLQGSRFVHDRKRQ--EVMDYEASTGPVYAYAYDLNTGATTL : 816
IPD050Fq : TNTGLVYMLLQGSRFLHDRKRE--EVMDYEASMGAVFAYAYDLNTGATTL : 813
IPD050Fi : TDNGFIYILLQSARSFSDRRVR--QAMDYEASEGLAYPYAYNLTTGVPSL : 793
IPD050Fj : TSSGLTYMLLQSSPVFRDRRRR--EVLEYEASMGLAYAFAYNLTTGVPTL : 825
IPD050Fp : TDSGKVYMLLQASRNFQDRLRR--EVLHYEAAVPLQYQYAYHLTTGETTV : 777
IPD050Gd : SQTGEVYLLLQSSANFQDRFEG--QVLEYEAAVPLVYQYAYNLTTGATTL : 821
IPD050Ga : TKTGEIYLVLRSSANFQDRLEE--QVFEYEAAVPLVYQYAYNLSTGATTL : 819
IPD050Gb : SETGEIYLLLRSSANFQDRLEE--QVLEYEAAVPLVYQYAYNLSTGATTL : 819
IPD050Gc : TDTGEIYLLLRSSANFQDRLEE--QVFEYEAAVPLVYQYAYNLSTGETTL : 819
                        β3              β4       β5
```

Fig. 16t

```
         -----][ motif 24][------ motif 5 -------][---------
              960         *         980         *        1000
IPD050Fb : SNLPSHDFIRAFMRMTPFA-TWRLRVSASAQENEGLAFPTATVG---AGD : 843
IPD050Fs : SNLPSYDFVRAFMRMTPFT-AWRLRVSASAQENEGLAFPTATVG---AGH : 848
IPD050Fo : SNLPSYDFIRAFMRMTPFT-TWRLRVSASAQENEGLAFPTATVG---TGD : 887
IPD050Fk : SNLPSYDFIRAFMRMTPFT-TWRLRVSASAQENEGLAFPTATAG---NGD : 888
IPD050Fe : SNSPSNEFIRTFMRMTPFT-TWRLRVSASAQENQGLAFPTTTVG---AGD : 836
IPD050Fl : SNSPSNDFIRTFMRMTPFT-TWRLRVSASAQENQGLAFPTTTVG---AGD : 838
IPD050Fn : SNSPSNDFIRTFMRMTPFT-TWRLRVSASAQENQGLAFPTTTVG---AGD : 840
IPD050Ft : SNLPSQDFTRTFMRMTPFT-NWRLRLSASAEENKGLGFPTATS----AGS : 864
IPD050Fh : TNQPSAEFRKTFMRSTPFT-NWRLRLSASAEENKGLAFPTATSA---D-A : 889
IPD050Fg : TNLPSAEFLRTFTRMTPFT-NWRLRLSASADENEGLAFPTATSA---D-A : 884
IPD050Fm : TNLPSAEFLRTFMRMTPFT-NWRLRVSASAEENKGLAFPTATSA---D-A : 881
IPD050Fd : TNLPSAEFLTTFMRMTPFT-NWGLRVSASAEENKGLAFSTATSA---D-A : 879
IPD050Fr : TNLPSAEFLTTFMRMTPFT-NWRVRVSASAEENKGLAFPTATSA---DAA : 885
IPD050Bb : TNIPTDEYANTFMRLTPFT-RWRLRLSLSAEENAGLAF-PTATS---ADD : 788
IPD050Bd : TNIPSEEYANTFMRLAPFT-RWRLRLSASADENKGLAF-PTATS---ADA : 786
IPD050Aa : TNVPSEEYANTFMRLAPFT-RWRLRLSASAPENKGLAF-PTATL---ADA : 787
IPD050Ba : TNVPSEAYVNTFMLLAPFT-RWRLRLSSSAPENKGLAF-PTATS---ADA : 787
IPD050Bc : TNVPSDAYVNTFMLLAPFT-RWRLRLSTSAPENKDLAF-PTATS---DDA : 786
IPD050Fa : NNIPSDQFKNIFMQMTPFT-TWRLRLSASAEENEGLVFHPPSTS---PTS : 859
IPD050Ff : NNIPSQQQANTFMQMTPFN-AWRLRLSASAAENQGLVF-PTATS---PDN : 861
IPD050Fq : SNIPSQQHANTFMQMTPFNAAWRLRLSASAMENQGLVF-PTATS---PDN : 859
IPD050Fi : TNLPSQEHANTFMRMTPFT-EWRLRLSSSAEENRGLTF-PTATS---PDD : 838
IPD050Fj : TNVPSPEFANTFMRMTPFNSNWRLRLSSSAMENQGLMF-PTASS---ADD : 871
IPD050Fp : ENRPSQQHHGEYMQMTPFG-QWRLRLSASAFENRNLAFPTAANTDL-DAA : 825
IPD050Gd : PNLPFES--GKFFRMTPFT-RWRLRLSASAYQNEGISFPTAN----SSDT : 864
IPD050Ga : PNLPSQS--GKFFRMTPFT-RWRLRLSASAYQNEGVSFPTLPDLPGAADS : 866
IPD050Gb : PNQPSES--GKFFRMTPFT-RWRLRLSASAYQNQGVSFPTLPGDPN-SDS : 865
IPD050Gc : PNLPSES--GKFFRMTPFT-RWRLRLSASAYQNEGVSFPTIPGDPTSADT : 866
IPD050Fb : CCCCCCCCCCCCCCCCCC-CCCCCCCCCCCCCCCCCCCC---CCC : 843
IPD050Fs : CCCCCCCCCCCCCCCCCC-CCCCCCCCCCCCCCCCCCCC---CCC : 848
IPD050Fo : CCCCCCCCCCCCCCCCCC-CCCCCCCCCCCCCCCCCCCC---CCC : 887
IPD050Fk : CCCCCCCCCCCCCCCCCC-CCCCCCCCCCCCCCCCCCCC---CCC : 888
IPD050Fe : CCCCCCCCCCCCCCCCCC-CCCCCCCCCCCCCCCCCCCC---CCC : 836
IPD050Fl : CCCCCCCCCCCCCCCCCC-CCCCCCCCCCCCCCCCCCCC---CCC : 838
IPD050Fn : CCCCCCCCCCCCCCCCCC-CCCCCCCCCCCCCCCCCCCC---CCC : 840
IPD050Ft : CCCCCCCCCCCCCCCCCC-CCCCCCCCCCCCCCCCCCCC----CCC : 864
IPD050Fh : CCCCCCCCCCCCCCCCCC-CCCCCCCCCCCCCCCCCCCC----C-C : 889
IPD050Fg : CCCCCCCCCCCCCCCCCC-CCCCCCCCCCCCCCCCCCCC----C-C : 884
IPD050Fm : CCCCCHHCCCCCCCCCCC-CCCCCCCCCCCCCCCCCCCC----C-C : 881
IPD050Fd : CCCCCCCCCCCCCCCCCC-CCCCCCCCCCCCCCCCCCCC----C-C : 879
IPD050Fr : CCCCCCCCCCCCCCCCCC-CCCCCCCCCCCCCCCCCCCC----CCC : 885
IPD050Bb : CCCCCCCCCCCCCCCCCC-CCCCCCCCCCCC-CCCCC----CCC : 788
IPD050Bd : CCCCCCCCCCCCCCCCCC-CCCCCCCCCCCC-CCCCC----CCC : 786
IPD050Aa : CCCCCCCCCCCCCCCCCC-CCCCCCCCCCCC-CCCCC----CCC : 787
IPD050Ba : CCCCCCCCCCCCCCCCCC-CCCCCCCCCCCC-CCCCC----CCC : 787
IPD050Bc : CCCCCCCCCCCCCCCCCC-CCCCCCCCCCCC-CCCCC----CCC : 786
IPD050Fa : CCCCCCCCCCCCCCCCCC-CCCCCCCCCCCCCCCCCC---CCC : 859
IPD050Ff : CCCCCCCCCCCCCCCCCC-CCCCCCCCCCCC-CCCCC---CCC : 861
IPD050Fq : CCCCCCCCCCCCCCCCCCCCCCCCCCCCCCC-CCCCC---CCC : 859
IPD050Fi : CCCCCCCCCCCCCCCCCC-CCCCCCCCCCCC-CCCCC---CCC : 838
IPD050Fj : CCCCCCCCCCCCCCCCCCCCCCCCCCCCCCC-CCCCC---CCC : 871
IPD050Fp : CCCCCCCCCCCCCCCCCC-CCCCCCCCCCCCCCCCCCCC-CCC : 825
IPD050Gd : CCCCCCC--CCCCCCCCC-CCCCCCCCCCCCCCCCCC----CCCC : 864
IPD050Ga : CCCCCCC--CCCCCCCCC-CCCCCCCCCCCCCCCCCCCCCCCCC : 866
IPD050Gb : CCCCCCC--CCCCCCCCC-CCCCCCCCCCCCCCCCCCCCC-CCC : 865
IPD050Gc : CCCCCCC--CCCCCCCCC-CCCCCCCCCCCCCCCCCCCCCCCCC : 866
                                   B6
```

Fig. 16u

```
         [-- Motif 14 ----]
                 *        1020         *
IPD050Fb : TTQIAITFHVSAIREIAL----------------  :  861
IPD050Fs : TTQIAITFHVSAIREIAF----------------  :  866
IPD050Fo : TTQIAITFHVSAIREIAL----------------  :  905
IPD050Fk : TTQIAVTFHVSAIREIAL----------------  :  906
IPD050Fe : TTQIAVTFSVSAIREISL----------------  :  854
IPD050Fl : TTQIAVTFYVSAIREISL----------------  :  856
IPD050Fn : TTQIAVTLYVSAIREISL----------------  :  858
IPD050Ft : TTQIAIIFYISAIRRISL----------------  :  882
IPD050Fh : TTQIVVTFHISAVRQVAF----------------  :  907
IPD050Fg : TTEIAITFHISAIRRISD----------------  :  902
IPD050Fm : TTHIAITFFISAIRQIAL----------------  :  899
IPD050Fd : TTQIAITFFISAIRQIAL----------------  :  897
IPD050Fr : TTHIAITFFISAIRQVAL----------------  :  903
IPD050Bb : TTQIKITFHVSAIRRISTRSDGVSS---------  :  813
IPD050Bd : TTQIKITFHVSAIRRISTFVADPK----------  :  810
IPD050Aa : TTRIKITFHVSAIRRISTRVAV------------  :  809
IPD050Ba : TTRIKITFHVSAIRRISLAR--------------  :  807
IPD050Bc : TTHIKITFHVSAIRRISLSR--------------  :  806
IPD050Fa : TTQVSITFHVTRIRRIDRFTSTVHQKHAS-----  :  888
IPD050Ff : TTQISITFYVTAIRRIDLRQEGDVE---------  :  886
IPD050Fq : TTQISITFYVTAIRRIDHRQEGDEE---------  :  884
IPD050Fi : STQISITFHITAIRAIDFRGMDDEERSKSDSSQK :  872
IPD050Fj : TTQITITFFISAIRGIDTRAAVEI----------  :  895
IPD050Fp : TTQISITFFVTAVRAVDFRSLDDQDM--------  :  851
IPD050Gd : SIQITITFYVTALPQIQSLS-EDPAVATTL----  :  893
IPD050Ga : PVQITITFYVTALPQIQTSS-TDQDPASTT----  :  895
IPD050Gb : PVQITITFFVTALPQIQSRS-LDMSDGDPTEE--  :  896
IPD050Gc : PVRITITFYVTALPQIQSRSLLDMST--------  :  892
IPD050Fb : CEEEEEEEHHHHHCCC------------------  :  861
IPD050Fs : CEEEEEEEHHHHHHCC------------------  :  866
IPD050Fo : CEEEEEEEHHHHHHCC------------------  :  905
IPD050Fk : CEEEEEEEHHHHHHHC------------------  :  906
IPD050Fe : EEEEEEEECCCHHCCC------------------  :  854
IPD050Fl : CCEEEEEEHHHHCCC-------------------  :  856
IPD050Fn : EEEEEEEEEHHHHHCCC-----------------  :  858
IPD050Ft : CEEEEEEEEEECCCC-------------------  :  882
IPD050Fh : CEEEEEEEEEHHHCCC------------------  :  907
IPD050Fg : CEEEEEEEEECCCC--------------------  :  902
IPD050Fm : CEEEEEEEHHHHHHHHHC----------------  :  899
IPD050Fd : CEEEEEEEEHHHHHHHC-----------------  :  897
IPD050Fr : CEEEEEEEEHHHHHHHC-----------------  :  903
IPD050Bb : EEEEEEEEEEECCCCCCCCCC-------------  :  813
IPD050Bd : EEEEEEEEEEECCCCCCCCCC-------------  :  810
IPD050Aa : EEEEEEEEEECCCCCC------------------  :  809
IPD050Ba : EEEEEEEEEECCCCCC------------------  :  807
IPD050Bc : EEEEEEEEEECCCCC-------------------  :  806
IPD050Fa : EEEEEEEEECCCHHHHHHCCCC------------  :  888
IPD050Ff : EEEEEEEEHHCCCCCCCC----------------  :  886
IPD050Fq : CEEEEEEECCCCCCCCCC----------------  :  884
IPD050Fi : CEEEEEEEEECCCCCCCCCCCCCCCC        :  872
IPD050Fj : EEEEEEEEECCCCCCCCCC---------------  :  895
IPD050Fp : CEEEEEEEECCCCCCCCCC---------------  :  851
IPD050Gd : CEEEEEEECCCCCCCC-CCCCCCCC----     :  893
IPD050Ga : CEEEEEEECCCCCCCCC-CCCCCCCC----    :  895
IPD050Gb : CEEEEEECCCCCCCCC-CCCCCCCCCC--     :  896
IPD050Gc : CEEEEEEECCCCHHHHCCCCCCC--------   :  892
                 β7
```

Fig. 17a

```
                        *         20          *         40         *
PtIP-65Gc  : -------------------------------------------------- :   -
PtIP-65Ha  : -------------------------------------------------- :   -
PtIP-65Gd  : -------------------------------------------------- :   -
PtIP-65Ge  : -------------------------------------------------- :   -
PtIP-65Ga  : -------------------------------------------------- :   -
PtIP-65Gb  : -------------------------------------------------- :   -
PtIP-65Hj  : -------------------------------------------------- :   -
PtIP-65Hk  : -------------------------------------------------- :   -
PtIP-65Hg  : MQYGLANTEASPLIEKFQALMEGGIDESILATKLVGAEGDASHLPPPGET  :  50
PtIP-65Hh  : ------------MAQLQQHVVN---------------------------- :  10
PtIP-65Fa  : -------------------------------------------------- :   -
PtIP-65Fb  : -------------------------------------------------- :   -
PtIP-65Ca  : -------------------------------------------------- :   -
PtIP-65Aa  : -------------------------------------------------- :   -
PtIP-65Ba  : -------------------------------------------------- :   -
PtIP-65Bb  : -------------------------------------------------- :   -
PtIP-65He  : -------------------------------------------------- :   -
PtIP-65Hf  : -------------------------------------------------- :   -
PtIP-65Hb  : -------------------------------------------------- :   -
PtIP-65Hc  : -------------------------------------------------- :   -
PtIP-65Hd  : -------------------------------------------------- :   -
PtIP-65Gc  : -------------------------------------------------- :   -
PtIP-65Ha  : -------------------------------------------------- :   -
PtIP-65Gd  : -------------------------------------------------- :   -
PtIP-65Ge  : -------------------------------------------------- :   -
PtIP-65Ga  : -------------------------------------------------- :   -
PtIP-65Gb  : -------------------------------------------------- :   -
PtIP-65Hj  : -------------------------------------------------- :   -
PtIP-65Hk  : -------------------------------------------------- :   -
PtIP-65Hg  : CCCCCCCCCCCHHHHHHHHHHHCCCCHHEEEEEECCCCCCCCCCCCCCCC  :  50
PtIP-65Hh  : ------------CCCCCEEEEE---------------------------- :  10
PtIP-65Fa  : -------------------------------------------------- :   -
PtIP-65Fb  : -------------------------------------------------- :   -
PtIP-65Ca  : -------------------------------------------------- :   -
PtIP-65Aa  : -------------------------------------------------- :   -
PtIP-65Ba  : -------------------------------------------------- :   -
PtIP-65Bb  : -------------------------------------------------- :   -
PtIP-65He  : -------------------------------------------------- :   -
PtIP-65Hf  : -------------------------------------------------- :   -
PtIP-65Hb  : -------------------------------------------------- :   -
PtIP-65Hc  : -------------------------------------------------- :   -
PtIP-65Hd  : -------------------------------------------------- :   -
```

Fig. 17b

```
                                                   [----motif 12----
                      60         *         80         *        100
PtIP-65Gc : ---------------------------------MALYQTPVYVIGGQ-GGS- :  17
PtIP-65Ha : ---------------------------------MALYQTPVYVIGGQ-GGS- :  17
PtIP-65Gd : ---------------------------------MALYQTPVYVIGGQ-GGN- :  17
PtIP-65Ge : ---------------------------------MALYQTPVYVIGGQ-GGN- :  17
PtIP-65Ga : ---------------------------------MSLVQTPVYVIGGQ-GGN- :  17
PtIP-65Gb : ---------------------------------MSLVQTPVYVIGGQ-GGN- :  17
PtIP-65Hj : ---------------------------------MSIHQTPVTLIGGR-GGA- :  17
PtIP-65Hk : -------------------------------MSSGSVIGGVTMVGGP-YGS- :  19
PtIP-65Hg : PSEDGAGKDPPN-ESLETEDVEEHADDSKARSASVTAPLRFIGGP-GGS- :  97
PtIP-65Hh : -SKHAYGKHAPASKVCEIARAPVHAYKG-SNQGDVTAPLTFIGGD-GGK- :  56
PtIP-65Fa : -----------------------------------MAFQTPVTLIGASSGGQ- :  17
PtIP-65Fb : -----------------------------------MAFQTPVTLIGGSSGGQ- :  17
PtIP-65Ca : -----------------------------------MALVIG--GLIGGG-GGS- :  15
PtIP-65Aa : -----------------------------------MALVIG--GLIGGQ-GGY- :  15
PtIP-65Ba : -----------------------------------MALVIS--CPVGGQ-GGS- :  15
PtIP-65Bb : -----------------------------------MALVIG--WPVGGQ-GGS- :  15
PtIP-65He : ------------------------------------MQPVQLAGSVNTSLG :  15
PtIP-65Hf : --------------------------MTSLLTPPYMQPIQSAGGLFSSF- :  23
PtIP-65Hb : -----------------------------MSLLT-PHLLTASAGG-FIGGD- :  20
PtIP-65Hc : ---------------------------MSSLIN-PHLETIRYGGSFAGGS- :  22
PtIP-65Hd : ---------------------------MSSLIN-PHLESITYAGSFAGGS- :  22
PtIP-65Gc : ---------------------------------CCEEEEEEEECCC-CCC- :  17
PtIP-65Ha : ---------------------------------CCEEEEEEEECCC-CCC- :  17
PtIP-65Gd : ---------------------------------CCEECCCEEECCC-CCC- :  17
PtIP-65Ge : ---------------------------------CCEECCCEEECCC-CCC- :  17
PtIP-65Ga : ---------------------------------CCCCCEEEEEECC-CCC- :  17
PtIP-65Gb : ---------------------------------CCCCCEEEEECCC-CCC- :  17
PtIP-65Hj : ---------------------------------CCEEEEEEEECCCC-CCC- :  17
PtIP-65Hk : -------------------------------CCCCCCCCEEECCC-CCC- :  19
PtIP-65Hg : CCCCCCCCCCCC-CCCCCCCCCCCCCCCCCCCCCCCEEEECCC-CCC- :  97
PtIP-65Hh : -CCCCCCCCCCCCEEEEECCEEECCC-CCCCCCEEEEEEECC-CCC- :  56
PtIP-65Fa : ----------------------------------CCCCCCEEEECCCCCCC- :  17
PtIP-65Fb : ----------------------------------CCCCCCEEEECCCCCCC- :  17
PtIP-65Ca : ----------------------------------CCEEECC--CCCCCC-CCC- :  15
PtIP-65Aa : ----------------------------------CCEEECC--CCCCCC-CCC- :  15
PtIP-65Ba : ----------------------------------CCEEECC--CCCCCC-CCC- :  15
PtIP-65Bb : ----------------------------------CCEEECC--CCCCCC-CCC- :  15
PtIP-65He : ------------------------------------CCCEEEECCCCCCCC :  15
PtIP-65Hf : --------------------------CCCCCCCCEEEEEECCCCCCE- :  23
PtIP-65Hb : -----------------------------CCCCC-CEEEEEEECC-CCCCC- :  20
PtIP-65Hc : ---------------------------CCCCCC-CEEEEEECCCCCCCC- :  22
PtIP-65Hd : ---------------------------CCCCCC-CCCCEEEECCCCCCCC- :  22
                                                    β1
```

Fig 17c

```
            ][-------- motif 2 -----------][------------
                   *       120         *       140         *
PtIP-65Gc : SFTYDQSRNGRVLTKIGVWAGEWQLRGIRVWMSGS--DTPATFGS-----  :  60
PtIP-65Ha : SFTYDQSRNGKVLRKIGVWAGEWQLRGIRVWMSGS--DSPATFGS-----  :  60
PtIP-65Gd : SFTYDQSRNGKVLTKIGVWAGEWQLRGIRVWMSGS--DSPTTFGT-----  :  60
PtIP-65Ge : SFTYDQSRNGKVLTKIGVWAGEWQLRGIRVWMSGS--DSPTTFGT-----  :  60
PtIP-65Ga : AFSYDQSRNGRILRRIGVWAGEWQLRGIRVWMTGT--DTPATFGT-----  :  60
PtIP-65Gb : AFTYDQSRNGRILRRIGVWAGEWQLRGIRVWMTGT--DTPATFGT-----  :  60
PtIP-65Hj : AFTYNAGASGRILRRIGVWAGGSQLRGIRVWWTGL--DSPITYGTP----  :  61
PtIP-65Hk : YQEVQAWQVGSYISRLTVYWESMRVRGARVWVKG--QSASTTFGDA----  :  63
PtIP-65Hg : QRSVRGWTNGRVITRMRVYRARGTIKAYQIWLT---DSAPQTHGVP----  : 140
PtIP-65Hh : QVSKRAWESGKLITRLRVYSGYSCIKAMKVWFTGDEYSEGTCLGEP----  : 102
PtIP-65Fa : QFSAYGGTDGKLLEKIGVWAGDSRIKAIKVWLTD---EAAQLFGDPHDPP :  64
PtIP-65Fb : QFSAYGGTDGKLLEKIGVWAGDSRIKAIKVWLTD---EAAQLFGDPHDPP :  64
PtIP-65Ca : YFSYYGGTDGRVMQRIRVWAATSRIKAISVWLSD---GVQRTFGDPSRPA :  62
PtIP-65Aa : AFNYYGGTDGRVMQRIKVWAATSRIKAISVWLSD---GVERTFGDPSRPA :  62
PtIP-65Ba : FFNYYGGTDGRVMQRIKVWAAASRIKAISVWLSD---GVQKTFGDPSRPA :  62
PtIP-65Bb : FFNYYGGTDGRVMQRIKVWAATSRIKAISVWLSD---GVQKTFGDPSRPS :  62
PtIP-65He : LWRVSSETEGKVLKRIRVYRLTRSIPAIEVWLTGD--SNPHVCGTPG---  :  60
PtIP-65Hf : --IVSGETEGKVLQRIRVYRFSRNIAAIEVWLTGD--SNPHLCGTPG---  :  66
PtIP-65Hb : IFRHSGETDGRVLHRIRLSREVARISAVEFWLTGN--STPYVYGTP----  :  64
PtIP-65Hc : PFRILGETEGRVLQRIRISRMANAIDAIEFWLTGD--STPRVYGTV----  :  66
PtIP-65Hd : PFRILGETQGRVLQRIRVSRIATRIEAIEFWLTGD--STPRVYGTV----  :  66
PtIP-65Gc : CCEEECCCCCCCCEEEEEEECCCEEEEEEEEEECC--CEEEEECC-----  :  60
PtIP-65Ha : CCEEECCCCCCCCEEEEEEECCCEEEEEEEEEECC--CEEEEECC-----  :  60
PtIP-65Gd : CCEEECCCCCCCCEEEEEEECCCEEEEEEEEEECC--CEEEEECC-----  :  60
PtIP-65Ge : CCEEECCCCCCCCEEEEEEECCCEEEEEEEEEECC--CEEEEECC-----  :  60
PtIP-65Ga : CCEEECCCCCCCCEEEEEEECCCEEEEEEEEEECC--CEEEEECC-----  :  60
PtIP-65Gb : CCEEECCCCCCCCEEEEEEECCCEEEEEEEEEECC--CEEEEECC-----  :  60
PtIP-65Hj : CCEEECCCCCCCCEEEEEEECCCCEEEEEEEEEECC--CEEEEECCC----  :  61
PtIP-65Hk : CCCCCCCCCCCCEEEEEEECCCEEEEEEEEEEC--CCEEEEECC----   :  63
PtIP-65Hg : CCEEECCCCCCCCEEEEEEECCCEEEEEEEEEE---CCCEEECCC----  : 140
PtIP-65Hh : CCEEECCCCCCCEEEEEEECCCEEEEEEEEEECCEEEEEEEECCC----  : 102
PtIP-65Fa : CCEEECCCCCCCCEEEEEEECCCCEEEEEEEEC---CCEEECCCCCCC  :  64
PtIP-65Fb : CCEEECCCCCCCCEEEEEEECCCCEEEEEEEEC---CCEEECCCCCCC  :  64
PtIP-65Ca : CCEEECCCCCCCCEEEEEEECCCCEEEEEEEEC---CCEEECCCCCCC  :  62
PtIP-65Aa : CCEEECCCCCCCCEEEEEEECCCCEEEEEEEEC---CCEEECCCCCCC  :  62
PtIP-65Ba : CCEEECCCCCCCCEEEEEEECCCCEEEEEEEEC---CCEEECCCCCCC  :  62
PtIP-65Bb : CCEEECCCCCCCCEEEEEEECCCCEEEEEEEEC---CCEEECCCCCCC  :  62
PtIP-65He : EEEEEECCCCEEEEEEEEECCCCEEEEEEEEECC--CCEEECCCC---  :  60
PtIP-65Hf : --EEECCCCCCEEEEEEEECCCCEEEEEEEEECC--CCCEEECCCC---  :  66
PtIP-65Hb : CCEEECCCCCCEEEEEEEECCCCEEEEEEEEECC--CEEEEECCC----  :  64
PtIP-65Hc : CEEECCCCCCCEEEEEEEEECCCCEEEEEEEEECC--CEEEEECCC---  :  66
PtIP-65Hd : CEEECCCCCCCEEEEEEEEECCCCEEEEEEEEECC--CEEEEEEE----  :  66
                              β2              β3            β4
```

Fig 17d

```
              ][-- motif 6 ---][------------ motif 1 --------
              160         *         180         *         200
PtIP-65Gc :  --ASGSYS YTFADGERITRLSLWG-------NGAGTRSGAIRFYTTTGG : 101
PtIP-65Ha :  --ASGSYS YTFADGERITRLSLWG-------NGAGTRSGAIRFYTTTGG : 101
PtIP-65Gd :  --ASGSYS YTFAAGERITRLSLWG-------NGAGTRSGAIRFYTTTGG : 101
PtIP-65Ge :  --ASGSYS YTFAAGERITRLSLWG-------NGAGTRSGAIRFYTTTGG : 101
PtIP-65Ga :  --ATGSYS YTFTDGERITRLSLWG-------NGAGTRSGGIRFYTTTGG : 101
PtIP-65Gb :  --ATGSYS YTFADGERITRLSLWG-------NGAGTRSGGIRFYTTTGG : 101
PtIP-65Hj :  --NVGSYQ FTFQDGERITSLSLWG-------NGAGTRSGGIRFYTTTGR : 102
PtIP-65Hk :  --TGS-SADFEFETGETITAMSLWQGEWE---NPDHIRAGHLYFTTSNGR : 107
PtIP-65Hg :  --GNSDFA YTFRTGERLTRLTLWG-------NGMGTRAGWIEFETSLGG : 181
PtIP-65Hh :  --DGTDYK YTFSEGERITRMSLWG-------NGNGTRAGWISLSTNKGG : 143
PtIP-65Fa :  GEGPLHYK FAFQPAELITRLSLWG-------NGAGTRAGWIYFETNQSR : 107
PtIP-65Fb :  GEGPLLYK FTFQPAELITRLSLWG-------NGAGTRAGWIYFETNRSR : 107
PtIP-65Ca :  GEGNLRSA FSFNTGERVTRLSLWG-------NGIGTRSGWIYFETNQGR : 105
PtIP-65Aa :  GEGDLRTS FRFNSGETVTSLSLWG-------NGAGTRSGWIYFRTSQNR : 105
PtIP-65Ba :  GEGDLRTS FSFNTGETVTQLSLWG-------NGAGTRSGWIYFRTNQNR : 105
PtIP-65Bb :  GEGDLETS FSFKTGETVTQLSLWG-------NGAGTRSGWLYFRTSHNR : 105
PtIP-65He :  ---RAESSTFEFSEGERITTLVLQDAQ-----NIP-THVGRIRFQTSLLR : 101
PtIP-65Hf :  ---RAESSTFEFSEGERITTLELQEDP-----QLPYTVVGRIRFQTSRLR : 108
PtIP-65Hb :  ---RADNSSYEFVDGERITRLDFRTHLFGVV-TIQWDNIARVRFSTSRGR : 110
PtIP-65Hc :  ---RSENSSFDFSEGERITGLRFRNALFGIG-QNQWNHVARVWFSTSRGR : 112
PtIP-65Hd :  ---RSENSSYDFAEGERITRLRFRTSRFGFGVQTQWDHVARVWFSTSRGR : 113
PtIP-65Gc :  --CCCCCE EEECCCCEEEEEEEE-------CCCCCEEEEEEEECCCC : 101
PtIP-65Ha :  --CCCCCE EEECCCCEEEEEEEE-------CCCCCEEEEEEEECCCC : 101
PtIP-65Gd :  --CCCCEE EEECCCCEEEEEEEE-------CCCCCEEEEEEEECCCC : 101
PtIP-65Ge :  --CCCCEE EEECCCCEEEEEEEE-------CCCCCEEEEEEEECCCC : 101
PtIP-65Ga :  --CCCCCE EEECCCCEEEEEEEE-------CCCCCEEEEEEEECCCC : 101
PtIP-65Gb :  --CCCCCE EEECCCCEEEEEEEE-------CCCCCEEEEEEEECCCC : 101
PtIP-65Hj :  --CCCCCE EEECCCCEEEEEEEE-------CCCCCEEEEEEEECCCC : 102
PtIP-65Hk :  --CCC-CE EEECCCCEEEEEEEEEC---CCCEEEEEEEEEECCCC : 107
PtIP-65Hg :  --CCCCCE EEECCCCEEEEEEEE-------CCCCCEEEEEEEECCCC : 181
PtIP-65Hh :  --CCCCCE EEECCCCEEEEEEEE-------CCCCCEEEEEEEECCCC : 143
PtIP-65Fa :  CCCCCCEE EEECCCCEEEEEEEE-------CCCCCEEEEEEEECCCC : 107
PtIP-65Fb :  CCCCCCEE EEECCCCEEEEEEEE-------CCCCCEEEEEEEECCCC : 107
PtIP-65Ca :  CCCCCCEE EEECCCCEEEEEEEE-------CCCCCEEEEEEEECCCC : 105
PtIP-65Aa :  CCCCCCEE EEECCCCEEEEEEEE-------CCCCCEEEEEEEECCCC : 105
PtIP-65Ba :  CCCCCCEE EEECCCCEEEEEEEE-------CCCCCEEEEEEEECCCC : 105
PtIP-65Bb :  CCCCCCEE EEECCCCEEEEEEEE-------CCCCCEEEEEEEECCCC : 105
PtIP-65He :  ---CCCCE EEECCCCEEEEEEEECC-----CCC-CEEEEEEEECCCC : 101
PtIP-65Hf :  ---CCCCE EEECCCCEEEEEEEECC-----CCCCCEEEEEEEECCCC : 108
PtIP-65Hb :  ---CCCCC EEECCCCEEEEEEEECCCCCCE-EEECEEEEEEEECCCC : 110
PtIP-65Hc :  ---CCCCE EEECCCCEEEEEEEEECCCC-CCCCEEEEEEEECCCC : 112
PtIP-65Hd :  ---CCCCE EEECCCCEEEEEEEEECCCCCCCEEEEEEEEECCCC : 113
                     β5          β6              β7
```

Fig 17e

```
                     ----------------][motif 16][ ----- motif 3------
                        *        220         *        240         *
PtIP-65Gc : SFFPKMTSWGLQT YPIDVASGLCVGILG--RANVDVDSLGFLFLR-TIA : 148
PtIP-65Ha : SFFPKMTSWGLKT YPMDVASGLCVGILG--RANVDVDSLGFLFLR-TIA : 148
PtIP-65Gd : SFFPKMTSWDLKT YPIDVASGLCVGIIG--RASADIDSLGFMFLR-TIA : 148
PtIP-65Ge : SFFPKMTSWDLKT YPIDVASGLCVGIIG--RASADIDSLGFMFLR-TIA : 148
PtIP-65Ga : SFFHKMTSWGLQT YPIDVASGLCVGITG--RANVDVDSLGVLFLR-TIA : 148
PtIP-65Gb : SFFHKMTSWGLQT YPIDVASGLCVGIMG--RANVDVDSLGVLFLR-TIA : 148
PtIP-65Hj : RFFHHMTSWGLKQ YPVDVVDGVCVGLTG--RQGADIDALGFMFLR-TMT : 149
PtIP-65Hk : EFSAGPS--TMWS TVIDVQSGWLVGLQA--YTGDDINKWGFVFLK-PLL : 152
PtIP-65Hg : RFSYGMSHWSLRTPYPVDVGSGILVGYIF--NAGEDVDAHGFWFLN-HIE : 228
PtIP-65Hh : VFSYGMHGWPLCT YPVNVGSGILAGAIY--NAGCDIDAHGYYFLSSSVT : 191
PtIP-65Fa : SFDFGMYSWGKKK YPVDVASGICAGVMG--TAASDINNIGFVFLK-PIQ : 154
PtIP-65Fb : SFDFGMYSWGKKK YPVDVASGICAGVMG--TAASDINNIGFVFLK-PIQ : 154
PtIP-65Ca : RFDFGMYSWGKQT FPQTVASGIWVGFTG--RASLDVDALGVVFLR-PIQ : 152
PtIP-65Aa : TFDFGMYSWGKKT YPQSVASGIWVGIRG--RASSDIDALGVVFLQ-RIQ : 152
PtIP-65Ba : TFDFGMYSWGKKT YPQDVSSGIWVGITG--RAKSDVDALGVVFLQ-PIL : 152
PtIP-65Bb : TFDFGMYSWGKKT YPQNVASGIWVGITG--RASSDLDGLGVVFLR-SIQ : 152
PtIP-65He : TFEYGMSVQPTGKVTTVNVGSGVCVGVRASHSSTYGISVFGFMFLR-PIQ : 150
PtIP-65Hf : TFEYGMSVQPSGRVITVNVGSGVCVGVRAGTALSV-ISILGFMFLR-PIR : 156
PtIP-65Hb : IFEFGSSREPSGQWFTANVGSGVCVGMSGVEANGA-LTRLGFMFLR-SIQ : 158
PtIP-65Hc : TFEYGSTREPTGQWFEVNVGSGVCVGVAGNVMLNS-LNMLGFVFLR-SIQ : 160
PtIP-65Hd : TFEYGSTREPSGQWFEANVGSGVCVGVAGNVMLDS-LNMLGFVFLR-SIQ : 161
                β8            β9      β10           β11
```

Fig 17f

```
              -----------]  [--- motif 15 ---]  [--- motif 7
                  260          *        280          *        300
PtIP-65Gc : SARMINVSYPTLGLEQAG------IIPITLDSYNDSNNAGAISKN-----  : 187
PtIP-65Ha : SARMINVSYPTLGLEQAG------IIPITLDSYNDSNNAGAISKN-----  : 187
PtIP-65Gd : SSRMINVSYPTLGLEQAG------IIPVTLDSYNDSNNAGSISKN-----  : 187
PtIP-65Ge : SSRMINVSYPTLGLEQAG------IIPVTLDSYNDSNNAGSISKN-----  : 187
PtIP-65Ga : PARMINVSYPTLGLEQAG------IIPVTLDSYNDSNNAGTISKN-----  : 187
PtIP-65Gb : SARMINVSYPTLGLEQAG------IIPVTLDSFNDSNNAGTISKN-----  : 187
PtIP-65Hj : SARMINVKYPTLGLETAG------IVPVTLDFMSDSNNASSISKT-----  : 188
PtIP-65Hk : VFALADVQYTGL-QDVGA------IVPTTLDSLDETNNSSTGSDVN----  : 191
PtIP-65Hg : QAELTNVRYPTLGFDTAG------IVPTALDTFRFRNNSST--PRD----  : 266
PtIP-65Hh : SSKLENVKYPTLKFDTSG------ITPVSLDTYKQTNTSSS--PRN----  : 229
PtIP-65Fa : SSKLINVQYPSLSFDTQG------ISPQTLKEFNHTN-TSNNPTN-----  : 192
PtIP-65Fb : SSKLINVQYPSLSFDTQG------ISPQTLKEFNHTN-TSNNPTS-----  : 192
PtIP-65Ca : SCQLMNVQYPTLQFSGSSGATSITPTASSTKSFTLLNTADHEDQSST---  : 199
PtIP-65Aa : SCRLTSVQYPTLQFSGSSGGTTSIVRTTPTKSFNLGNTADQDDPSST---  : 199
PtIP-65Ba : SCRLISVDYPTLQFSGTSGGTTSINLTTAGKTFNLQNAAHQEDPSST---  : 199
PtIP-65Bb : SCRLINVQYPTLQFSGTAGGTTSITRTTAAKTFNLQNTANQDDPSST---  : 199
PtIP-65He : SVRLHGLVYPTISSTSTITTTILQELPATIKNDNDHEPLHWVLAGSRQCI  : 200
PtIP-65Hf : SVRLHGLVYPTISSISTITTTILQELPATLKNDDDHEPLHWVLAGSRQCF  : 206
PtIP-65Hb : SVGFSSVEYPTLSTSTILTTPILEQLPDTFKSNDDDEPLHVVLAGSRQLE  : 208
PtIP-65Hc : SVGFSSVEYPMFSTS-ITRTSILEQLPDTFKSNDDDEPLQMVLAGSRQFK  : 209
PtIP-65Hd : RVGFTSVEYPTISSS-IARTFILSHLPDTFKSNDDDEPLQMVLAGSRQFK  : 210
                                β12
```

Fig 17g

```
                        ------------------]        [-------- motif 5 --
                        *         320       *         340          *
PtIP-65Gc : ----WTFSGSRTVT-ISSSWTLTT------GIEAHASVTVQAGIPSVAEV : 226
PtIP-65Ha : ----WTFSGSRTVT-ISSSWTLTT------GIEAHASVTVQAGIPSVAEV : 226
PtIP-65Gd : ----WTFSGSRTVT-ISSSWTLTS------GIEAHASVTVQAGIPSVAEV : 226
PtIP-65Ge : ----WTFSGSRTVT-ISSSWTLTS------GIEAHASVTVQAGLPSVAEV : 226
PtIP-65Ga : ----WTFSGSRTVT-ISSSWSLTS------GIETHASVSVQAGIPMVAEV : 226
PtIP-65Gb : ----WTFSGSRTVT-ISSSWSLTS------GIETHASVSVQAGIPMVAEV : 226
PtIP-65Hj : ----WSFQGSREVT-VSSSWSTTT------GIELHASITVSAGIPLVANV : 227
PtIP-65Hk : ----WSLEGSKAET-VSWSFSTTD------SLTATIGFEVSAGIPEVAQV : 230
PtIP-65Hg : ----WDFSRNMSRS-TERTWSITV------DLTVHASITVSAGFPGIANV : 305
PtIP-65Hh : ----WSFGGKRTVK-STTKWGLKI------ANTFNVELSVEAGVPQVSKS : 268
PtIP-65Fa : ----WEFKGSSAVT-VSSSWSLTT------GLAVHASVTVEAGIPAVADV : 231
PtIP-65Fb : ----WEFKGSSAVT-VSSSWSLTT------GLAVHASVTVEAGIPAVADV : 231
PtIP-65Ca : QQLAWELADEPRFDNVFLSWILSNPSAGLLQFITTSSISVQARIPALAVV : 249
PtIP-65Aa : EQLAWQLADEPSFDNVSHSWSLSNTSTGLLQFIATSTVSVQARTPALAVV : 249
PtIP-65Ba : EKLAWELADEPSFDNVSHTWSLSNISTRLLQFISTSTISVQARTPALAVV : 249
PtIP-65Bb : EQLAWQLADEPSFDNVSHTWSLSNTSTGLLQFISTSTISVQARTPALTIV : 249
PtIP-65He : TSSTWRTQPADREGLVSHLVGRAISINIDLGIDTPKIVATGGTAGASTNF : 250
PtIP-65Hf : TSSTWRTQLAYRAGLVSHLVGSAISINMDLGIDAPKIVATGGTAGASTNF : 256
PtIP-65Hb : TTSTW---TSPAVGLLSHLTGNDITVNVSLGINTPTVVPSG-PEGASTTF : 254
PtIP-65Hc : TSSTWR-VSSPTVGLLSHLTGNNILVDVTLGINTPTVVPTG-LAGASTTF : 257
PtIP-65Hd : TTSTWR-AQSPAVGLLSHLTANNITLDLTLGINTPTVVPTG-TAGASTAF : 258
                                        β13
```

Fig. 17h

```
              ----------]      [- motif 23 -][-----------------
                   360          *         380         *         400
PtIP-65Gc :  S-GEFGWSVSVT----GSYTSTQEESR--TLTWNQSGTLEPGQWIS-IQA  : 268
PtIP-65Ha :  S-GEFGWSVSVT----GSYTSTQEESR--TLTWNQSGTLEPGQWIS-IQA  : 268
PtIP-65Gd :  S-GEFGWSVSVS----GSYTSTQEESR--TLTWNQSGTLEPGQWIS-IQA  : 268
PtIP-65Ge :  S-GEFGWSVSVS----GSYTSTQEESR--TLTWNQSGTLEPGQWIS-IQA  : 268
PtIP-65Ga :  S-GEFGWSVSVS----GTYATTQEESR--TLTWNQSGTLEPGQWIS-LQA  : 268
PtIP-65Gb :  S-GEFGWSVSVS----GTYATTQEESR--TLTWNQSGTLEPGQWIS-LQA  : 268
PtIP-65Hj :  E-GQYGWAISTS----STYTTNHSETR--TLQWQNSGVLEPGQWIS-LQA  : 269
PtIP-65Hk :  K-ESFQFQVGTS----TTRSSSYSEEH--TLTWSTGGVLKPGQHVV-ASA  : 272
PtIP-65Hg :  S-GQYGWEIGVT----GHFETTETSEH--DLSWSVGGRVQPGDVVD-LTA  : 347
PtIP-65Hh :  G-AKFGWTISVA----SDHEESEERTQ--ELVWSTGGTLQPGETVD-LVA  : 310
PtIP-65Fa :  S-GEFGWEVSAS----TTSQSSTTETD--TLSWGVSGTLSAGESIH-LKA  : 273
PtIP-65Fb :  S-GEFGWEVSAS----TTSESSTTETD--TLSWGVSGTLSAGESIH-LKA  : 273
PtIP-65Ca :  N-NVVGWQLSAS----DTQSSSLSSSSSLSLPWSRSGSLLPSQSLTTLSA  : 294
PtIP-65Aa :  N-DVVGWQLSAS----DTQSSSLSSSSSLLLPWSRSGSLLPSKSFA-LSA  : 293
PtIP-65Ba :  NNIVVGWQLSAS----DTESSSLSSSSSLLLPWSRNGSLLPSESLT-LSA  : 294
PtIP-65Bb :  N-DVVGWLPSDS----DTQSSSLSSSSSLLLPWSRNGSLLPSESLT-LSA  : 293
PtIP-65He :  GWETARTFPSTN-AVEGSIADLTVRTNEYSVWGHVSDTLAPAQSLISRRA  : 299
PtIP-65Hf :  GWETARTFPSTN-AIQGSIADLIVSTNAYSVWGHVSDTLAPAQSLISRRA  : 305
PtIP-65Hb :  HWQTVRTFPSSN-AMEGSIANLTVTTNEYSVWCHISDTIAPAQLLP-KHV  : 302
PtIP-65Hc :  QWETVRAFPSTN-AIQGSISNLTVSTDEYSVWCHISDTVAPAQSLP-KHA  : 305
PtIP-65Hd :  QWQTVRTFPSINAEIQGTIANLTVSTAEYSVWCHISDTVAPAQSIP-KHS  : 307
```

```
          -------motif 4 ---------------     ----]
                 *         420         *        440         *
PtIP-65Gc : TTR-RGTIT-LPYQGTM ITLQSGTVFRYP-----ISSMYSGVDYTSVDI : 311
PtIP-65Ha : TTR-RGTIT-LPYQGTM ITLQSGTVFRYP-----ISSMYSGVDYTSVDI : 311
PtIP-65Gd : TTR-RGTIT-LPYQGTM ITLQSGTVFQYP-----ISSMYSGVDYTSVDI : 311
PtIP-65Ge : TTR-RGTIT-LPYQGTM ITLQSGTVFQYP-----ISSMYSGVDYTSVDI : 311
PtIP-65Ga : TTR-RGTIT-LPFQATM ITLLSGTIFQYA-----ISSMYSGVDYTSVDI : 311
PtIP-65Gb : TTR-RGTIT-LPFQATM ITLLSGTIFQYA-----ISSMYSGVDYTSVDI : 311
PtIP-65Hj : LTR-RGTIT-LPYQATM ITLQNGTVFTYP-----ITAQYAGVDYTSVEI : 312
PtIP-65Hk : VTQ-VGTLSGLPYTATVVIKTKDASSYSYA-----TSGSYSGISCTEVQL : 316
PtIP-65Hg : LTR-TGTLN-IPYEGTMVVRMRNGASFSYA-----VRGTYRGLSYTGTKI : 390
PtIP-65Hh : LTR-QGNLNDLRFEGTMVVTLKNGASFRFP-----LSGPYKGICYTGVEI : 354
PtIP-65Fa : LTR-KGLIS-VPYIGSI VTLKSGDVFQYP-----LKGQYSGISYSGVTV : 316
PtIP-65Fb : LTR-KGLIS-VPYTGSI VTLKSGDIFQYP-----LKGQFSGVSYSGVTV : 316
PtIP-65Ca : LTY-RGDARNLFFNGSA VTTTTGSRFSFPG----LQGLFTGQSYV-PAI : 338
PtIP-65Aa : LPY-RGNVSGLSFNGSARVTTSGGT-FSFSG----LQGRFTGQSYA-IDI : 336
PtIP-65Ba : LPF-GGTVSGLPFDGSARVTTTGGT-FSFSG----LHGFYTGQSHV-IAI : 337
PtIP-65Bb : LPY-DGIVNGLPFTGSARVTTSHGT-FSFSG----LKGAFTGESHV-IAV : 336
PtIP-65He : VLIGEGSIDNLQCSARI VFTDADGGLPFATFTFPVGVLYSARAHSDVQV : 349
PtIP-65Hf : ALIGEGRIDNLQCSARI VFTN-DSALSLATFTFPVGVLYSARAHSDVQV : 354
PtIP-65Hb : ALVGEGRITALPCSARI VLTSSAYDLPFATFSFPVQSLYNGRAHSVQI : 352
PtIP-65Hc : AWVGEGRITALPCSANI VFTSGGNNFPFGTFSFPVRLLYDGGAHSNVQV : 355
PtIP-65Hd : AWVGEGRITALPCSANI VITSGGNNLPFASFSFPVRLFYDGGAHSTVQV : 357
                               β14                              β15
```

Fig 17j

```
                   [- motif 22      ] [- motif 8 -
            460        *       480       *        500
PtIP-65Gc : TNTGTR-------ALKNEVEVEAVDQ------QSQ-EGDHNVQPNK---- : 343
PtIP-65Ha : TNTGTR-------ALKNEVEVEAVDQ------QSQ-EGDHNVQPNK---- : 343
PtIP-65Gd : TNTGTR-------ALK-QVEVQATDQ------QSQ-EGDHNVQPDK---- : 342
PtIP-65Ge : TNTGTR-------ALK-QVEVQATDQ------QSQ-EGDHNVQPDK---- : 342
PtIP-65Ga : TNTGTR-------ASD-HVEVEATEQ------QVQGVKDQSVQPNK---- : 343
PtIP-65Gb : TNTGTR-------ASD-HVEVEATEQ------QVQGVKDQSVQPNK---- : 343
PtIP-65Hj : VSQGTRDLGSDHLAINKDVRYIAAANGAAVGTTTTNAPPHYVHPIRGAPI : 362
PtIP-65Hk : DVKVT--------------------------------------------- : 321
PtIP-65Hg : NDNST--------------------------------------------- : 395
PtIP-65Hh : KDHEETKTMAMKSYASLCL-------------------------------- : 373
PtIP-65Fa : T------------------------------------------------- : 317
PtIP-65Fb : T------------------------------------------------- : 317
PtIP-65Ca : TSQ----------------------------------------------- : 341
PtIP-65Aa : TTQ----------------------------------------------- : 339
PtIP-65Ba : TTQ----------------------------------------------- : 340
PtIP-65Bb : TAQ----------------------------------------------- : 339
PtIP-65He : LS------------------------------------------------ : 351
PtIP-65Hf : LS------------------------------------------------ : 356
PtIP-65Hb : IDP----------------------------------------------- : 355
PtIP-65Hc : L------------------------------------------------- : 356
PtIP-65Hd : L------------------------------------------------- : 358

PtIP-65Gc : EEECCC-------CCCCCHHHHHCC------EEC-CCCCCCCCCC---- : 343
PtIP-65Ha : EEECCC-------CCCCCHHHHHCC------EEC-CCCCCCCCCC---- : 343
PtIP-65Gd : EEEEEE-------CCC-CCCCCCCCC------CCC-CCCCCCCCCC---- : 342
PtIP-65Ge : EEEEEE-------CCC-CCCCCCCCC------CCC-CCCCCCCCCC---- : 342
PtIP-65Ga : EEECCC-------CCC-CEEEEEEEC------EECCCCCCCCCCCC---- : 343
PtIP-65Gb : EEECCC-------CCC-CCEEHHEEE------EECCCCCCCCCCCC---- : 343
PtIP-65Hj : EEEEECCCCCCCCCCCCCCEEEEECCCCEEEEEECCCCCCCCCCCCCCCE : 362
PtIP-65Hk : EEEEC--------------------------------------------- : 321
PtIP-65Hg : EECCC--------------------------------------------- : 395
PtIP-65Hh : EEECCCCEEECCCCCCCCC-------------------------------- : 373
PtIP-65Fa : C------------------------------------------------- : 317
PtIP-65Fb : C------------------------------------------------- : 317
PtIP-65Ca : ECC---------------------------------------------- : 341
PtIP-65Aa : EEC----------------------------------------------- : 339
PtIP-65Ba : ECC---------------------------------------------- : 340
PtIP-65Bb : ECC---------------------------------------------- : 339
PtIP-65He : EC------------------------------------------------ : 351
PtIP-65Hf : CC------------------------------------------------ : 356
PtIP-65Hb : ECC----------------------------------------------- : 355
PtIP-65Hc : C------------------------------------------------- : 356
PtIP-65Hd : C------------------------------------------------- : 358
```

Fig 17k

```
                                         ---------]
                          *        520         *
PtIP-65Gc : ---------------------EVQESKLLFIE------ : 354
PtIP-65Ha : ---------------------EVQESKVLFIE------ : 354
PtIP-65Gd : ---------------------EVEERKVLFTE------ : 353
PtIP-65Ge : ---------------------EVEERKVLFTE------ : 353
PtIP-65Ga : ---------------------EAKECTLLFAE------ : 354
PtIP-65Gb : ---------------------EAKECTLLFAE------ : 354
PtIP-65Hj : VEPVKFSVGATYINDTDNITQEVDTTAATSVEELTLVY : 400
PtIP-65Hk : -------------------------------------- : -
PtIP-65Hg : -------------------------------------- : -
PtIP-65Hh : -------------------------------------- : -
PtIP-65Fa : -------------------------------------- : -
PtIP-65Fb : -------------------------------------- : -
PtIP-65Ca : -------------------------------------- : -
PtIP-65Aa : -------------------------------------- : -
PtIP-65Ba : -------------------------------------- : -
PtIP-65Bb : -------------------------------------- : -
PtIP-65He : -------------------------------------- : -
PtIP-65Hf : -------------------------------------- : -
PtIP-65Hb : -------------------------------------- : -
PtIP-65Hc : -------------------------------------- : -
PtIP-65Hd : -------------------------------------- : -
PtIP-65Gc : ---------------------CCCCEEEEEEC------ : 354
PtIP-65Ha : ---------------------CCCCEEEEEEC------ : 354
PtIP-65Gd : ---------------------CCCCCEEEEEC------ : 353
PtIP-65Ge : ---------------------CCCCCEEEEEC------ : 353
PtIP-65Ga : ---------------------CCCEEEEEEEC------ : 354
PtIP-65Gb : ---------------------CCCEEEEEEEC------ : 354
PtIP-65Hj : ECCCCCCCCCEEEEECCCCCEEEEEEEEECCEEEEEEC : 400
PtIP-65Hk : -------------------------------------- : -
PtIP-65Hg : -------------------------------------- : -
PtIP-65Hh : -------------------------------------- : -
PtIP-65Fa : -------------------------------------- : -
PtIP-65Fb : -------------------------------------- : -
PtIP-65Ca : -------------------------------------- : -
PtIP-65Aa : -------------------------------------- : -
PtIP-65Ba : -------------------------------------- : -
PtIP-65Bb : -------------------------------------- : -
PtIP-65He : -------------------------------------- : -
PtIP-65Hf : -------------------------------------- : -
PtIP-65Hb : -------------------------------------- : -
PtIP-65Hc : -------------------------------------- : -
PtIP-65Hd : -------------------------------------- : -
```

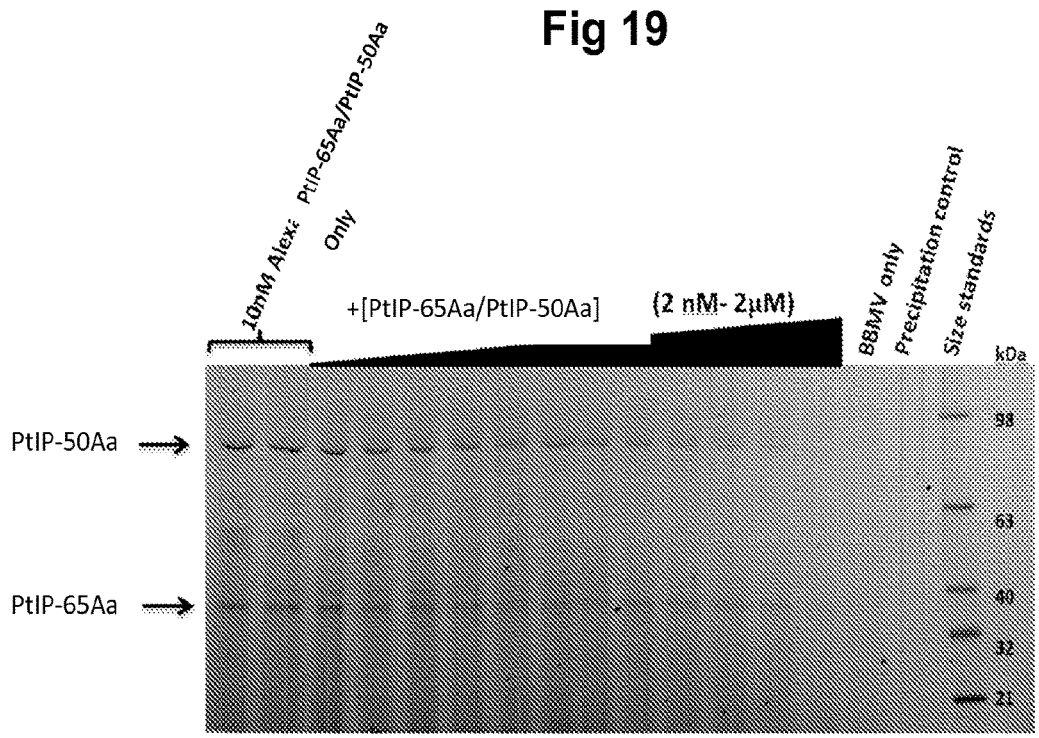

US 10,480,007 B2

INSECTICIDAL PROTEINS FROM PLANTS

CROSS REFERENCE

This application is a 371 (National Stage) of PCT/US15/14816 filed Feb. 6, 2015, which claims the benefit of U.S. Provisional Application No. 61/937,288 filed Feb. 7, 2014, which are incorporated herein by reference in their entirety.

REFERENCE TO SEQUENCE LISTING SUBMITTED ELECTRONICALLY

The official copy of the sequence listing is submitted electronically via EFS-Web as an ASCII formatted sequence listing with a file named "20150203_5295 PCT_SeqListing" created on Feb. 3, 2015, and having a size of 1,281 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of Bt. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY

Compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant. Compositions also comprise transformed bacteria, plants, plant cells, tissues and seeds.

In particular, isolated or recombinant nucleic acid molecules are provided encoding *Pteridophyta* Insecticidal Protein-50 (PtIP-50) polypeptides including amino acid substitutions, deletions, insertions, fragments thereof, and combinations thereof and *Pteridophyta* Insecticidal Protein-65 (PtIP-65) polypeptides including amino acid substitutions, deletions, insertions, fragments thereof, and combinations thereof. Additionally, amino acid sequences corresponding to the PtIP-50 polypeptides and PtIP-65 polypeptides are encompassed. Provided are isolated or recombinant nucleic acid molecules of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 capable of encoding PtIP-50 polypeptides as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. Also provided are isolated or recombinant PtIP-50 polypeptides of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98 as well as amino acid substitutions, deletions, insertions, fragments thereof and combinations thereof. Provided are isolated or recombinant nucleic acid molecules of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20 or SEQ ID NO: 21 capable of encoding PtIP-65 polypeptides as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. Also provided are isolated or recombinant PtIP-65 polypeptides of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 as well as amino acid substitutions, deletions, insertions, fragments thereof and combinations thereof.

Methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

Methods for detecting the nucleic acids and polypeptides of the embodiments in a sample are also included. A kit for detecting the presence of a PtIP-50 polypeptide and/or a PtIP-65 polypeptide or detecting the presence of a polynucleotide encoding a PtIP-50 polypeptide and/or a PtIP-65 polypeptide in a sample is provided. The kit may be provided along with all reagents and control samples necessary for carrying out a method for detecting the intended agent, as well as instructions for use.

The compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of PtIP-50 polypeptides or nucleic acids and PtIP-65 polypeptides or nucleic acids in products or organisms.

BRIEF DESCRIPTION OF THE FIGURES

FIGS. 3a-3i show an alignment of the amino acid sequences of PtIP-65Aa (SEQ ID NO: 22), PtIP-65Ba (SEQ ID NO: 24), PtIP-65Bb (SEQ ID NO: 26), PtIP-65Ca (SEQ ID NO: 29), PtIP-65Fa (SEQ ID NO: 41), PtIP-65Fb (SEQ ID NO: 42), PtIP-65Ga (SEQ ID NO: 30), PtIP-65Gb (SEQ ID NO: 34), PtIP-65Gc (SEQ ID NO: 27), PtIP-65Gd (SEQ ID NO: 35), PtIP-65Ge (SEQ ID NO: 36), PtIP-65Ha (SEQ ID NO: 25), PtIP-65Hb (SEQ ID NO: 31), PtIP-65Hc (SEQ ID NO: 23), PtIP-65Hd (SEQ ID NO: 28), PtIP-65He (SEQ ID NO: 32), PtIP-65Hf (SEQ ID NO: 33), PtIP-65Hg (SEQ ID NO: 40), PtIP-65Hh (SEQ ID NO: 38), PtIP-65Hj (SEQ ID NO: 39), and PtIP-65Hk (SEQ ID NO: 37). The amino acid diversity is indicated with shading.

FIGS. 4a-4b show an alignment of the amino acid sequences of PtIP-65Aa (SEQ ID NO: 22), PtIP-65Ba (SEQ ID NO: 24), PtIP-65Bb (SEQ ID NO: 26), and PtIP-65Ca (SEQ ID NO: 29), The amino acid diversity between PtIP-65Aa and PtIP-65Ba (SEQ ID NO: 24), PtIP-65Bb (SEQ ID NO: 26), and PtIP-65Ca is indicated with shading.

FIGS. 5a-5c show an alignment of the amino acid sequences of PtIP-65Ga (SEQ ID NO: 30), PtIP-65Gb (SEQ ID NO: 34), PtIP-65Gc (SEQ ID NO: 27), PtIP-65Gd (SEQ ID NO: 35), PtIP-65Ge (SEQ ID NO: 36), PtIP-65Ha (SEQ ID NO: 25). The amino acid diversity between PtIP-65Ga (SEQ ID NO: 30) and PtIP-65Gb (SEQ ID NO: 34), PtIP-65Gc (SEQ ID NO: 27), PtIP-65Gd (SEQ ID NO: 35), PtIP-65Ge (SEQ ID NO: 36), and PtIP-65Ha (SEQ ID NO: 25) is indicated with shading.

FIGS. 6a-6c show an alignment of the amino acid sequences of PtIP-65Hb (SEQ ID NO: 31), PtIP-65Hc (SEQ ID NO: 23), PtIP-65Hd (SEQ ID NO: 28), PtIP-65He (SEQ ID NO: 32), and PtIP-65Hf (SEQ ID NO: 33). The amino acid diversity between PtIP-65Hb (SEQ ID NO: 31) and PtIP-65Hc (SEQ ID NO: 23), PtIP-65Hd (SEQ ID NO: 28), PtIP-65He (SEQ ID NO: 32), and PtIP-65Hf (SEQ ID NO: 33) is indicated with shading.

FIG. 7 shows an alignment of the amino acid sequences of PtIP-65Fa (SEQ ID NO: 41) and PtIP-65Fb (SEQ ID NO: 42). The amino acid diversity between PtIP-65Fa (SEQ ID NO: 41) and PtIP-65Fb (SEQ ID NO: 42) is indicated with shading.

FIGS. 8a-8b show an alignment of the amino acid sequences of PtIP-65Hg (SEQ ID NO: 40) and PtIP-65Hh (SEQ ID NO: 38). The amino acid diversity between PtIP-65Hg (SEQ ID NO: 40) and PtIP-65Hh (SEQ ID NO: 38) is indicated with shading.

Figure 10H:
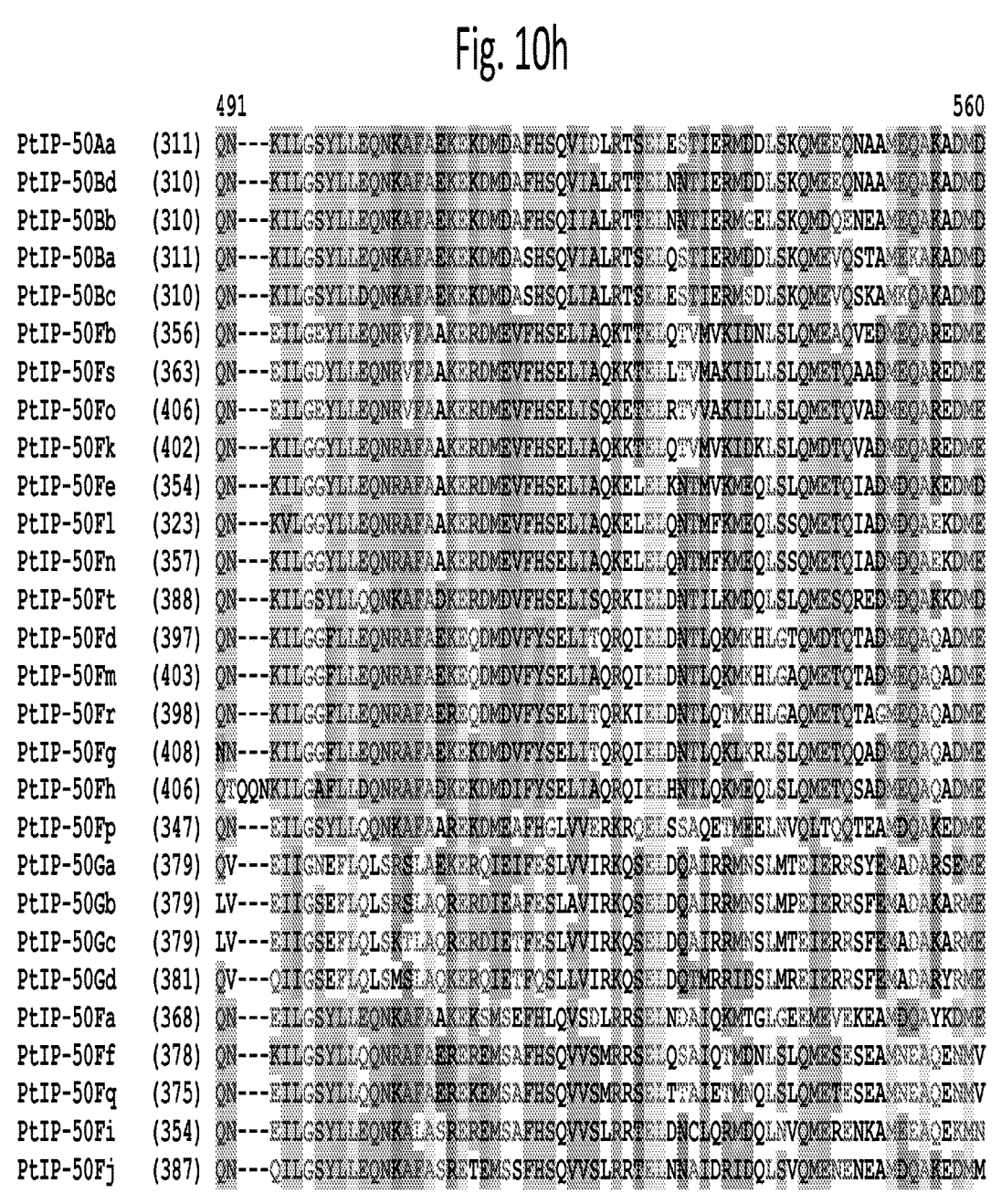
Figure 10J:
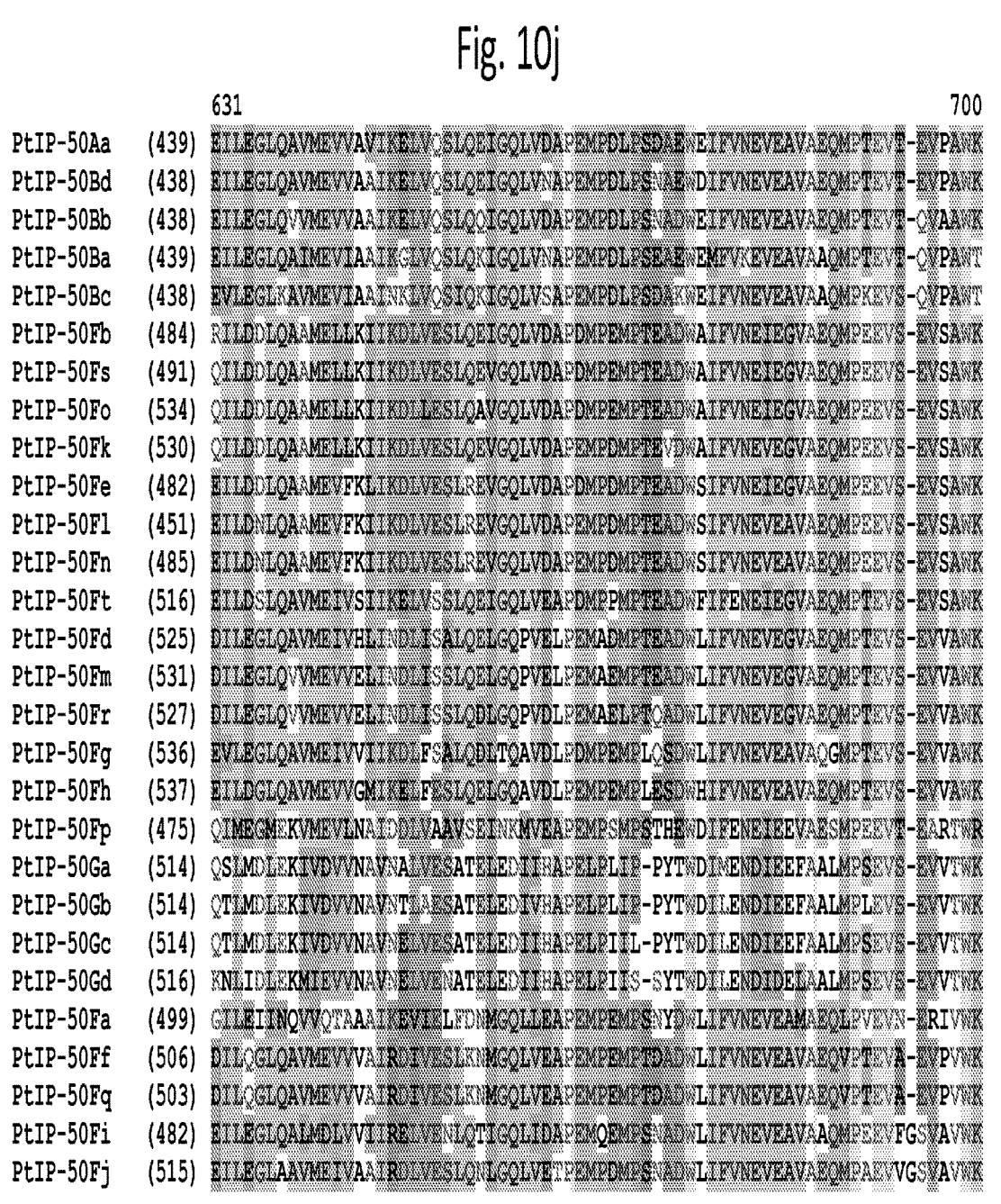
Figure 10K:
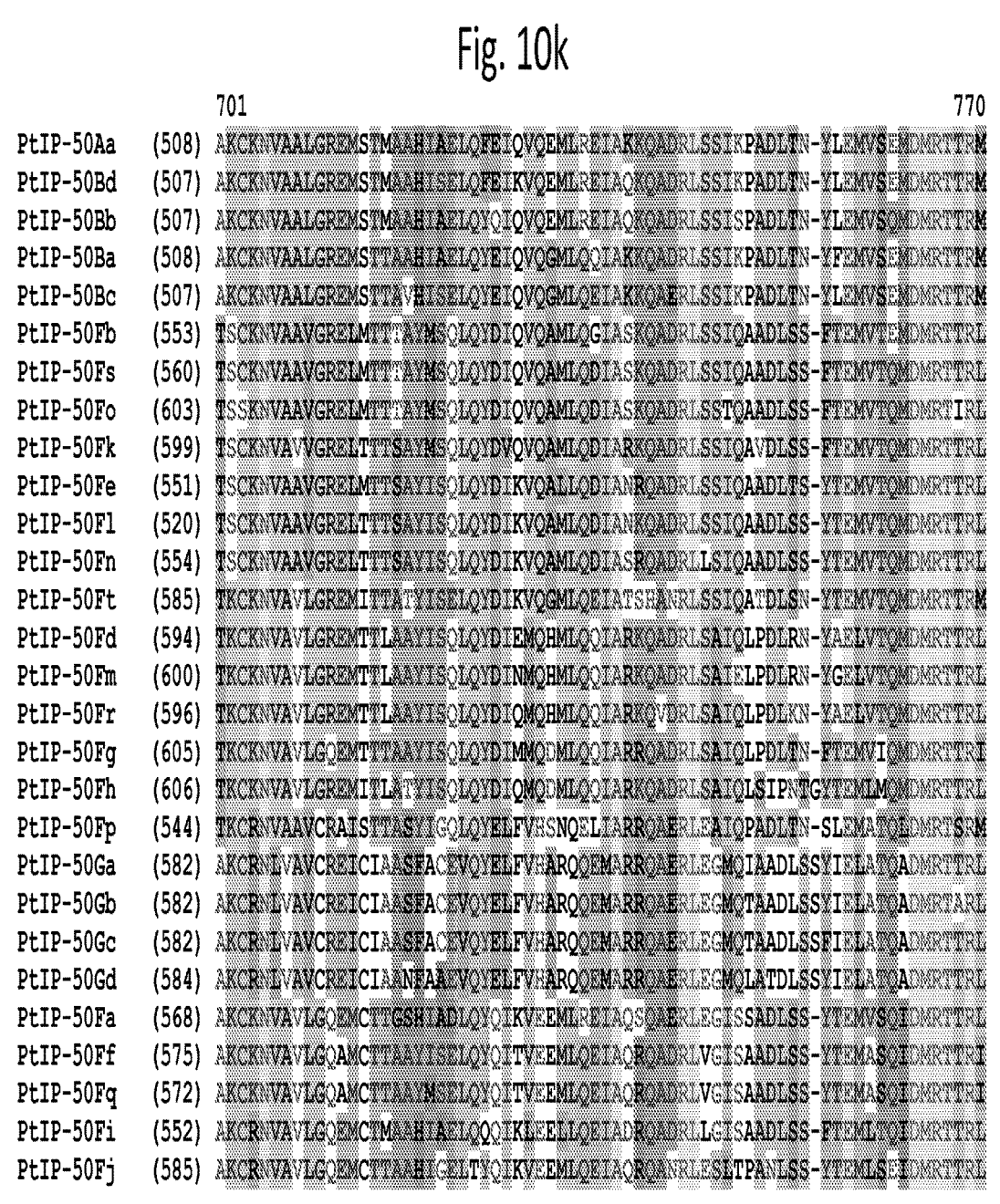
Figure 10N:
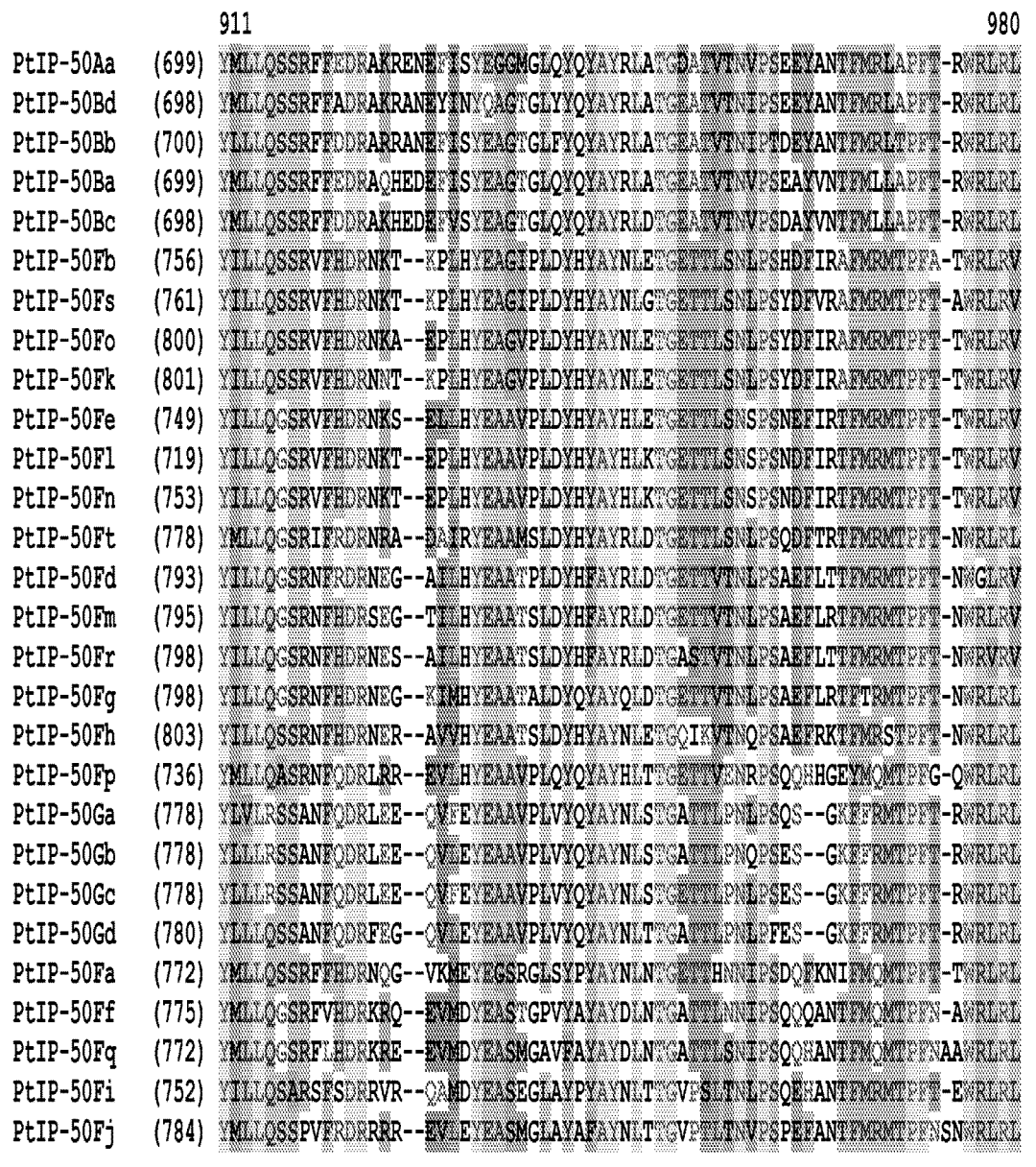

FIGS. 10a-10o show an alignment of the amino acid sequences of PtIP-50Aa (SEQ ID NO: 71), PtIP-50Ba (SEQ ID NO: 77), PtIP-50Bb (SEQ ID NO: 84), PtIP-50Bc (SEQ ID NO: 78), PtIP-50Bd (SEQ ID NO: 96), PtIP-50Fa (SEQ ID NO: 86), PtIP-50Fb (SEQ ID NO: 72), PtIP-50Fd (SEQ ID NO: 87), PtIP-50Fe (SEQ ID NO: 79), PtIP-50Ff (SEQ ID NO: 83), PtIP-50Fg (SEQ ID NO: 82), PtIP-50Fh (SEQ ID NO: 81), PtIP-50Fi (SEQ ID NO: 90), PtIP-50Fj (SEQ ID NO: 91), PtIP-50Fk (SEQ ID NO: 89), PtIP-50Fl (SEQ ID NO: 94), PtIP-50Fm (SEQ ID NO: 98), PtIP-50Fn (SEQ ID NO: 93), PtIP-50Fo (SEQ ID NO: 73), PtIP-50Fp (SEQ ID NO: 97), PtIP-50Fq (SEQ ID NO: 95), PtIP-50Fr (SEQ ID NO: 75), PtIP-50Fs (SEQ ID NO: 74), PtIP-50Ft (SEQ ID NO: 85), PtIP-50Ga (SEQ ID NO: 88), PtIP-50Gb (SEQ ID NO: 80, PtIP-50Gc (SEQ ID NO: 76), and PtIP-50Gd (SEQ ID NO: 92).

FIGS. 11a-11f show an alignment of the amino acid sequences of PtIP-50Aa (SEQ ID NO: 71), PtIP-50Ba (SEQ ID NO: 77), PtIP-50Bb (SEQ ID NO: 84), PtIP-50Bc (SEQ ID NO: 78), and PtIP-50Bd (SEQ ID NO: 96). The amino acid diversity between PtIP-51Aa (SEQ ID NO: 71) and PtIP-50Ba (SEQ ID NO: 77), PtIP-50Bb (SEQ ID NO: 84), PtIP-50Bc (SEQ ID NO: 78), and PtIP-50Bd (SEQ ID NO: 96) is indicated with shading.

FIGS. 12a-12j show an alignment of the amino acid sequences of PtIP-50Fb (SEQ ID NO: 72), PtIP-50Fe (SEQ ID NO: 79), PtIP-50Fk (SEQ ID NO: 89), PtIP-50Fl (SEQ ID NO: 94), PtIP-50Fn (SEQ ID NO: 93), PtIP-50Fo (SEQ ID NO: 73), PtIP-50Fs (SEQ ID NO: 74), and PtIP-50Ft (SEQ ID NO: 85). The amino acid diversity between PtIP-50Fb (SEQ ID NO: 72) and PtIP-50Fe (SEQ ID NO: 79), PtIP-50Fk (SEQ ID NO: 89), PtIP-50Fl (SEQ ID NO: 94), PtIP-50Fn (SEQ ID NO: 93), PtIP-50Fo (SEQ ID NO: 73), PtIP-50Fs (SEQ ID NO: 74), and PtIP-50Ft (SEQ ID NO: 85) is indicated with shading.

FIGS. 13a-13e show an alignment of the amino acid sequences of PtIP-50Fd (SEQ ID NO: 87), PtIP-50Fg (SEQ ID NO: 82), PtIP-50Fh (SEQ ID NO: 81), PtIP-50Fm (SEQ ID NO: 98), and PtIP-50Fr (SEQ ID NO: 75). The amino acid diversity between PtIP-50Fd (SEQ ID NO: 87) and PtIP-50Fg (SEQ ID NO: 82), PtIP-50Fh (SEQ ID NO: 81), PtIP-50Fm (SEQ ID NO: 98), and PtIP-50Fr (SEQ ID NO: 75) is indicate with shading.

FIGS. 14a-14e show an alignment of the amino acid sequences of PtIP-50Ga (SEQ ID NO: 88), PtIP-50Gb (SEQ ID NO: 80, PtIP-50Gc (SEQ ID NO: 76), and PtIP-50Gd (SEQ ID NO: 92). The amino acid diversity between PtIP-50Ga (SEQ ID NO: 88) and PtIP-50Gb (SEQ ID NO: 80, PtIP-50Gc (SEQ ID NO: 76), and PtIP-50Gd (SEQ ID NO: 92) is indicated with shading.

FIGS. 15a-15e show an alignment of the amino acid sequences of PtIP-50Fa (SEQ ID NO: 86), PtIP-50Ff (SEQ ID NO: 83), PtIP-50Fi (SEQ ID NO: 90), PtIP-50Fj (SEQ ID NO: 91), and PtIP-50Fq (SEQ ID NO: 95). The amino acid diversity between PtIP-50Fa (SEQ ID NO: 86) and PtIP-50Ff (SEQ ID NO: 83), PtIP-50Fi (SEQ ID NO: 90), PtIP-50Fj (SEQ ID NO: 91), and PtIP-50Fq (SEQ ID NO: 95) is indicated with shading.

FIGS. 16a-16u show: an alignment of the amino acid sequences of PtIP-50Aa (SEQ ID NO: 71), PtIP-50Ba (SEQ ID NO: 77), PtIP-50Bb (SEQ ID NO: 84), PtIP-50Bc (SEQ ID NO: 78), PtIP-50Bd (SEQ ID NO: 96), PtIP-50Fa (SEQ ID NO: 86), PtIP-50Fb (SEQ ID NO: 72), PtIP-50Fd (SEQ ID NO: 87), PtIP-50Fe (SEQ ID NO: 79), PtIP-50Ff (SEQ ID NO: 83), PtIP-50Fg (SEQ ID NO: 82), PtIP-50Fh (SEQ ID NO: 81), PtIP-50Fi (SEQ ID NO: 90), PtIP-50Fj (SEQ ID NO: 91), PtIP-50Fk (SEQ ID NO: 89), PtIP-50Fl (SEQ ID NO: 94), PtIP-50Fm (SEQ ID NO: 98), PtIP-50Fn (SEQ ID NO: 93), PtIP-50Fo (SEQ ID NO: 73), PtIP-50Fp (SEQ ID NO: 97), PtIP-50Fq (SEQ ID NO: 95), PtIP-50Fr (SEQ ID NO: 75), PtIP-50Fs (SEQ ID NO: 74), PtIP-50Ft (SEQ ID NO: 85), PtIP-50Ga (SEQ ID NO: 88), PtIP-50Gb (SEQ ID NO: 80, PtIP-50Gc (SEQ ID NO: 76), and PtIP-50Gd (SEQ ID NO: 92); an alignment of the secondary structure prediction for each of the PtIP-50 polypeptides, by the PSIPRED, top ranked secondary structure prediction method; and the locations of the amino acid sequence motifs, as predicted by MEME motif analysis, relative to PtIP-50Fb (SEQ ID NO: 72). A "H" indicates a predicted helical structure, an "E" indicates a PtIP-beta strand structure, and a "C" indicates a predicted coil structure.

FIGS. 17a-17k show an alignment of the amino acid sequences of PtIP-65Aa (SEQ ID NO: 22), PtIP-65Ba (SEQ ID NO: 24), PtIP-65Bb (SEQ ID NO: 26), PtIP-65Ca (SEQ ID NO: 29), PtIP-65Fa (SEQ ID NO: 41), PtIP-65Fb (SEQ ID NO: 42), PtIP-65Ga (SEQ ID NO: 30), PtIP-65Gb (SEQ ID NO: 34), PtIP-65Gc (SEQ ID NO: 27), PtIP-65Gd (SEQ ID NO: 35), PtIP-65Ge (SEQ ID NO: 36), PtIP-65Ha (SEQ ID NO: 25), PtIP-65Hb (SEQ ID NO: 31), PtIP-65Hc (SEQ ID NO: 23), PtIP-65Hd (SEQ ID NO: 28), PtIP-65He (SEQ ID NO: 32), PtIP-65Hf (SEQ ID NO: 33), PtIP-65Hg (SEQ ID NO: 40), PtIP-65Hh (SEQ ID NO: 38), PtIP-65Hj (SEQ ID NO: 39), and PtIP-65Hk (SEQ ID NO: 37); an alignment of the secondary structure prediction for each of the PtIP-65 polypeptides, by the PSIPRED, top ranked secondary structure prediction method; and the locations of the amino acid sequence motifs, as predicted by MEME motif analysis, relative to PtIP-65Gc (SEQ ID NO: 27). A "H" indicates a predicted helical structure, an "E" indicates a PtIP-beta strand structure, and a "C" indicates a predicted coil structure.

FIG. 19 shows a gel image of the specific binding of PtIP-50Aa (SEQ ID NO: 71) and PtIP-65Aa (SEQ ID NO: 22) to BBMVs from *C. includens*.

FIG. 20a shows the average densitometry values for bound Alexa-PtIP-50Aa (SEQ ID NO: 71) in the presence of different concentrations of unlabeled PtIP-50Aa (SEQ ID NO: 71) and PtIP-65Aa (SEQ ID NO: 22) normalized to the amount bound in the absence of unlabeled PtIP-50Aa (SEQ ID NO: 71) and PtIP-65Aa (SEQ ID NO: 22). The solid line reflects the best fit of a square logistic equation to the data. FIG. 20b shows the average densitometry values for bound Alexa-PtIP-65Aa (SEQ ID NO: 22) in the presence of different concentrations of unlabeled PtIP-50Aa (SEQ ID NO: 71) and PtIP-65Aa (SEQ ID NO: 22) normalized to the amount bound in the absence of unlabeled PtIP-50Aa (SEQ ID NO: 71) and PtIP-65Aa (SEQ ID NO: 22).

DETAILED DESCRIPTION

Figure 1:
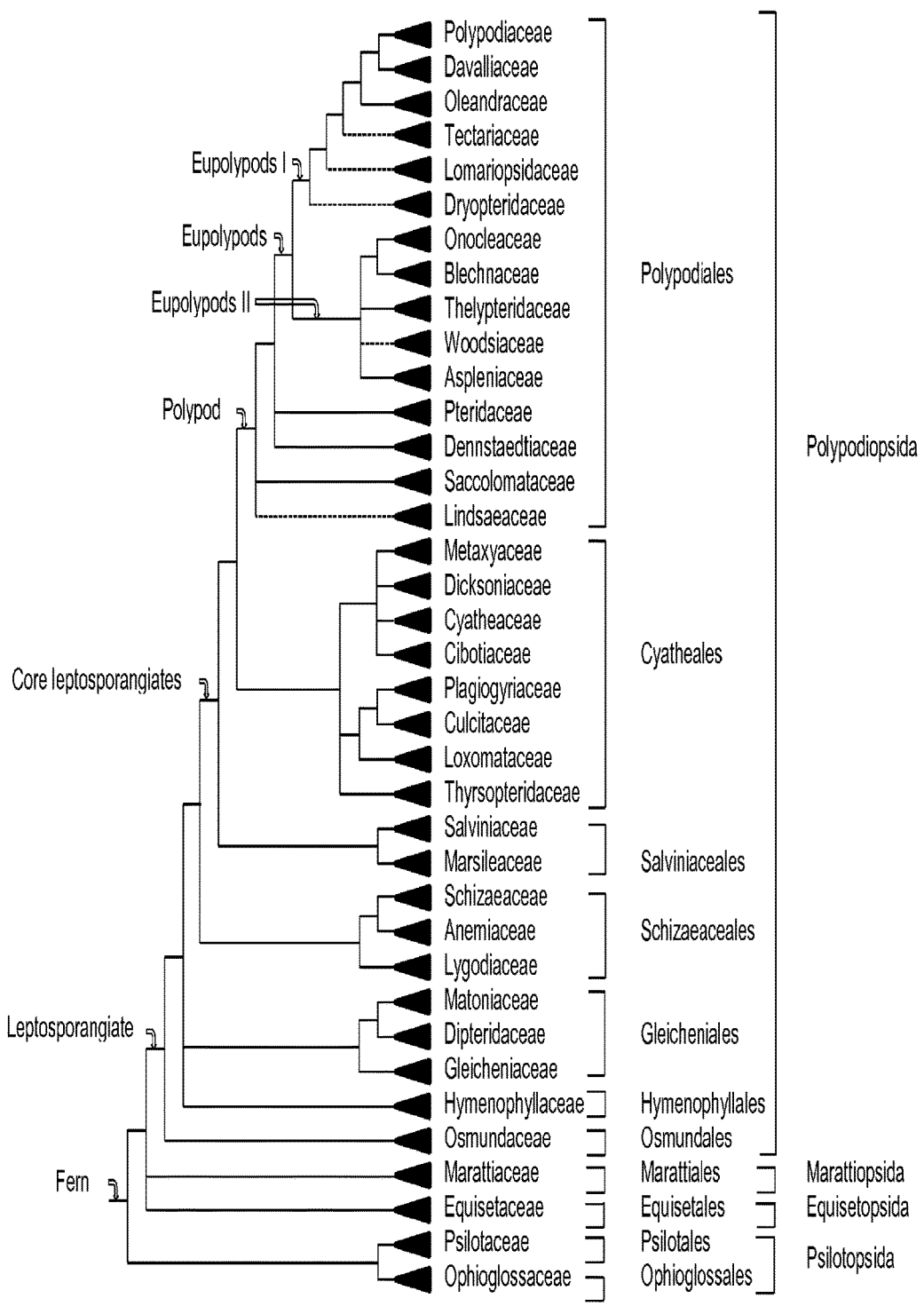
FIG. 1 the phylogeny of ferns based on the classification for extant ferns by A. R. Smith et al, *TAXON*, 55:705-731 (2006).
Figure 2:
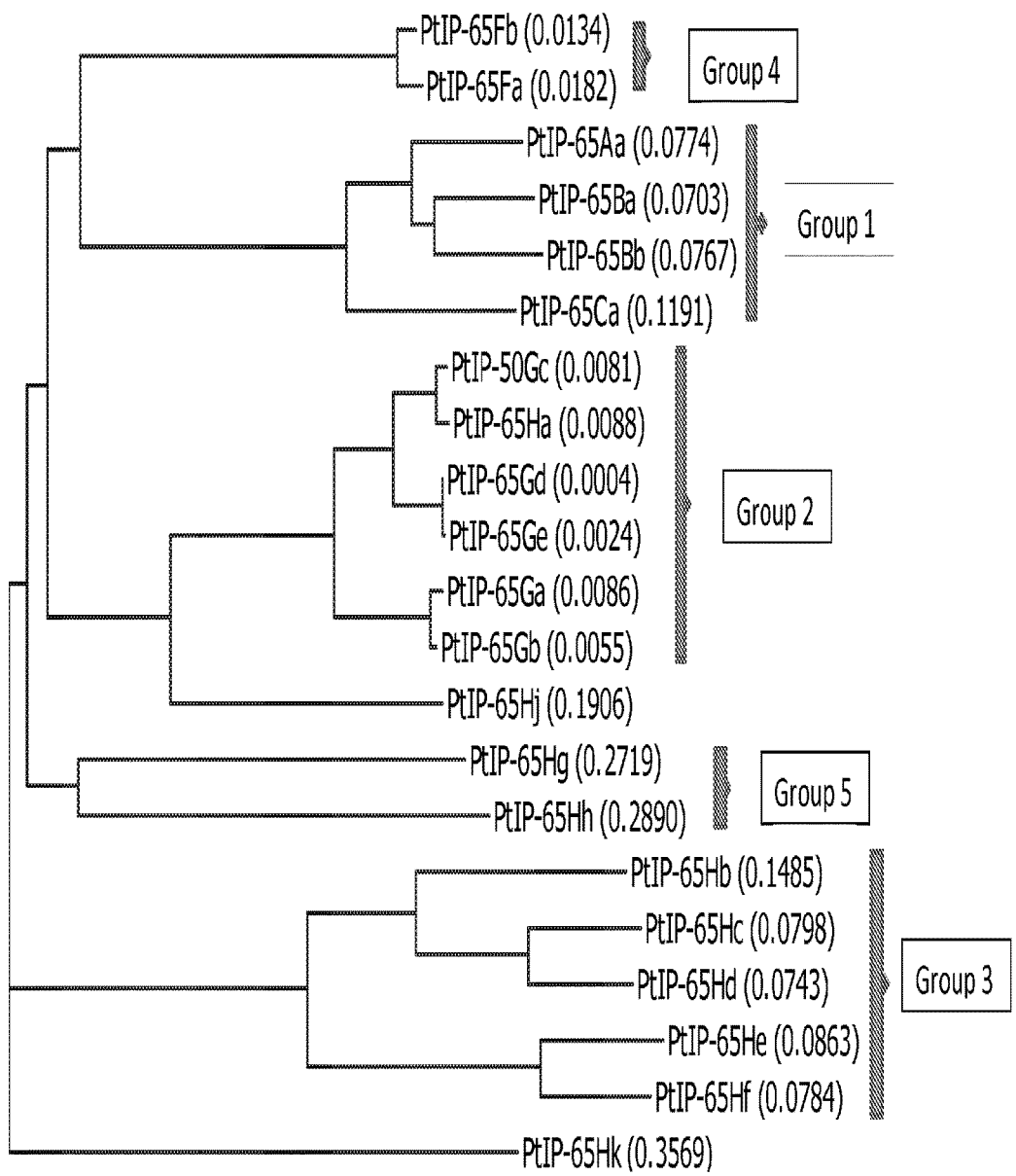
FIG. 2 shows the phylogeny tree of the PtIP-65 polypeptides: PtIP-65Aa (SEQ ID NO: 22), PtIP-65Ba (SEQ ID NO: 24), PtIP-65Bb (SEQ ID NO: 26), PtIP-65Ca (SEQ ID NO: 29), PtIP-65Fa (SEQ ID NO: 41), PtIP-65Fb (SEQ ID NO: 420, PtIP-65Ga (SEQ ID NO: 30), PtIP-65Gb (SEQ ID NO: 34), PtIP-65Gc (SEQ ID NO: 27), PtIP-65Gd (SEQ ID NO: 35), PtIP-65Ge (SEQ ID NO: 36), PtIP-65Ha (SEQ ID NO: 25), PtIP-65Hb (SEQ ID NO: 31), PtIP-65Hc (SEQ ID NO: 23), PtIP-65Hd (SEQ ID NO: 28), PtIP-65He (SEQ ID NO: 32), PtIP-65Hf (SEQ ID NO: 33), PtIP-65Hg (SEQ ID NO: 40), PtIP-65Hh (SEQ ID NO: 38), PtIP-65Hj (SEQ ID NO: 39), and PtIP-65Hk (SEQ ID NO: 37).
Figure 9:
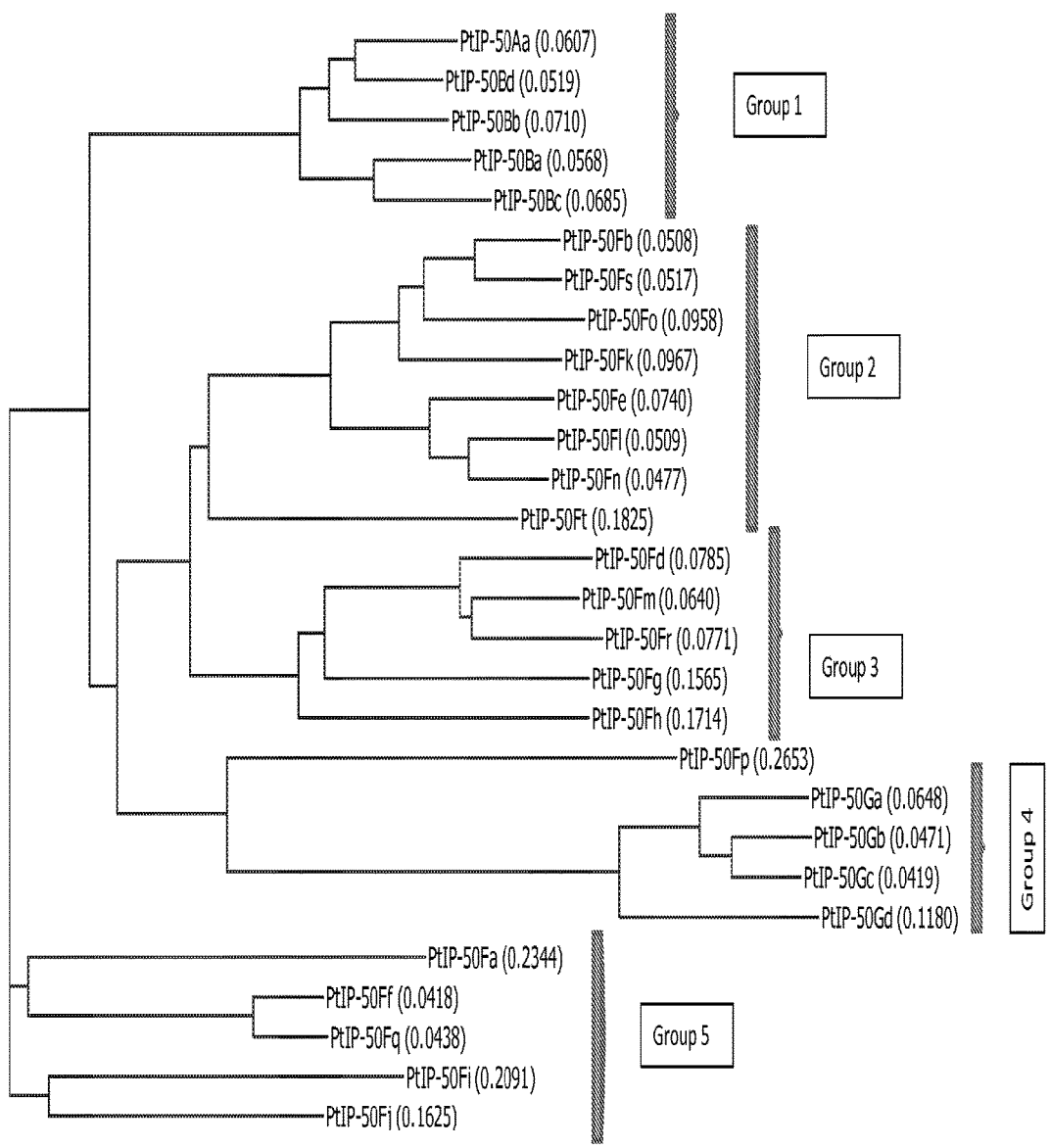
FIG. 9 shows the phylogeny tree of the PtIP-50 polypeptides: PtIP-50Aa (SEQ ID NO: 71), PtIP-50Ba (SEQ ID NO: 77), PtIP-50Bb (SEQ ID NO: 84), PtIP-50Bc (SEQ ID NO: 78), PtIP-50Bd (SEQ ID NO: 96), PtIP-50Fa (SEQ ID NO: 86), PtIP-50Fb (SEQ ID NO: 72), PtIP-50Fd (SEQ ID NO: 87), PtIP-50Fe (SEQ ID NO: 79), PtIP-50Ff (SEQ ID NO: 83), PtIP-50Fg (SEQ ID NO: 82), PtIP-50Fh (SEQ ID NO: 81), PtIP-50Fi (SEQ ID NO: 90), PtIP-50Fj (SEQ ID NO: 91), PtIP-50Fk (SEQ ID NO: 89), PtIP-50Fl (SEQ ID NO: 94), PtIP-50Fm (SEQ ID NO: 98), PtIP-50Fn (SEQ ID NO: 93), PtIP-50Fo (SEQ ID NO: 73), PtIP-50Fp (SEQ ID NO: 97), PtIP-50Fq (SEQ ID NO: 95), PtIP-50Fr (SEQ ID NO: 75), PtIP-50Fs (SEQ ID NO: 74), PtIP-50Ft (SEQ ID NO: 85), PtIP-50Ga (SEQ ID NO: 88), PtIP-50Gb (SEQ ID NO: 80, PtIP-50Gc (SEQ ID NO: 76), and PtIP-50Gd (SEQ ID NO: 92).

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding PtIP-50 polypeptides and PtIP-65 polypeptides. In particular, the nucleic acid sequences of the embodiments are useful for preparing plants and microorganisms that possess pesticidal activity. Thus, transformed bacteria, plants, plant cells, plant tissues and seeds are provided. The compositions are pesticidal nucleic acids and proteins of fern species. The nucleic acid sequences find use in the construction of expression vectors for subsequent transformation into organisms of interest, as probes for the isolation of other homologous (or partially homologous) genes, and for the generation of altered PtIP-50 polypeptides and PtIP-65 polypeptides by methods known in the art, such as site directed mutagenesis, domain swapping or DNA shuffling. The PtIP-50 polypeptides and PtIP-65 polypeptides find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: Corn Earworm, (CEW) (*Helicoverpa zea*), European Corn Borer (ECB) (*Ostrinia nubilalis*), diamond-back moth, e.g., *Helicoverpa zea* Boddie; soybean looper, e.g., *Pseudoplusia includens* Walker; and velvet bean caterpillar e.g., *Anticarsia gemmatalis* Hübner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

By "pesticidal toxin" or "pesticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) *PLoS Pathogens* 7:1-13); from *Pseudomonas protegens* strain CHAO and Pf-5 (previously *fluorescens*) (Pechy-Tarr, (2008) *Environmental Microbiology* 10:2368-2386; GenBank Accession No. EU400157); from *Pseudomonas Taiwanensis* (Liu, et al., (2010) *J. Agric. Food Chem.,* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal,* 3:101-118 and Morgan, et al., (2001) *Applied and Envir. Micro.* 67:2062-2069); U.S. Pat. Nos. 6,048,838, and 6,379,946; a PIP-1 polypeptide of U.S. Ser. No. 13/792,861; an AfIP-1A and/or AfIP-1B polypeptide of U.S. Ser. No. 13/800,233; a PHI-4 polypeptide of U.S. Ser. No. 13/839,702; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51 and Cry55 classes of δ-endotoxin genes and the *B. thuringiensis* cytolytic cyt1 and cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession # I26149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession # I12419); Cry1Ab12 (Accession # AAC64003); Cry1Ab13 (Accession # AAN76494); Cry1Ab14 (Accession # AAG16877); Cry1Ab15 (Accession # AAO13302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession # I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession

JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # ABO20894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession # AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession # I76415); Cry1Da3 (Accession # HQ439784); Cry1Db1 (Accession # CAA80234); Cry1Db2 (Accession # AAK48937); Cry1Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # ABI83671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261);

Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # ABO30519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4 (Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession # I15475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession # I34543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # ACI44005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1

(Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession # AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession # I32932); Cry21Aa2 (Accession # I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession # I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # ACI22625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BAI44026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BAI44022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # K0156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # K0156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # K0156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # ABI14444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EAO57254); Cry60Aa3 (Accession # EEM99278); Cry60Ba1 (Accession # GU810818); Cry60Ba2 (Accession # EAO57253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BAI44028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession

ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569); Cyt1Aa (GenBank Accession Number X03182); Cyt1Ab (GenBank Accession Number X98793); Cyt1B (GenBank Accession Number U37196); Cyt2A (GenBank Accession Number Z14147); and Cyt2B (GenBank Accession Number U52043).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E and Cry9F families; a Cry15 protein of Naimov, et al., (2008) *Applied and Environmental Microbiology*, 74:7145-7151; a Cry22, a Cry34Ab1 protein of U.S. Pat. Nos. 6,127,180, 6,624,145 and 6,340,593; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US Patent Application Publication Number 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-008orf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent Application Publication Number 2010/0005543, cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); and Cry3A and Cry1Ab or Vip3Aa (US20130116170). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex-.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

In some embodiments the PtIP-50 polypeptide or the PtIP-65 polypeptide include amino acid sequences deduced from the full-length nucleic acid sequences disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of PtIP-50 polypeptides and PtIP-65 polypeptides. The protein resulting from translation of these PtIP-50 polypeptide and the PtIP-65 polypeptide genes allows cells to control or kill pests that ingest it.

Nucleic Acid Molecules, and Variants and Fragments Thereof

One aspect pertains to isolated or recombinant nucleic acid molecules comprising nucleic acid sequences encoding PtIP-50 polypeptides, PtIP-65 polypeptides or biologically active portions thereof, as well as nucleic acid molecules sufficient for use as hybridization probes to identify nucleic acid molecules encoding proteins with regions of sequence homology. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecule encoding PtIP-50 polypeptides or PtIP-65 polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding PtIP-50 polypeptides or PtIP-65 polypeptides has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding a PtIP-50 polypeptide or PtIP-65 polypeptide is a non-genomic sequence.

A variety of polynucleotides that encode PtIP-50 polypeptides, PtIP-65 polypeptides or related proteins are contemplated. Such polynucleotides are useful for production of PtIP-50 polypeptides and PtIP-65 polypeptides in host cells when operably linked to suitable promoter, transcription termination and/or polyadenylation sequences. Such polynucleotides are also useful as probes for isolating homologous or substantially homologous polynucleotides that encode PtIP-50 polypeptides, PtIP-65 polypeptides or related proteins.

Polynucleotides Encoding PtIP-50 Polypeptides

One source of polynucleotides that encode PtIP-50 polypeptides or related proteins is a fern or other primitive plant species which contains a PtIP-50 polynucleotide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 encoding a PtIP-50 polypeptide of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98. The polynucleotides of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, and SEQ ID NO:

70 can be used to express PtIP-50 polypeptides in bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode PtIP-50 polypeptides or related proteins. Such probes can be used to identify homologous or substantially homologous polynucleotides derived from *Pteridophyta* species.

Polynucleotides that encode PtIP-50 polypeptides can also be synthesized de novo from a PtIP-50 polypeptide sequence. The sequence of the polynucleotide gene can be deduced from a PtIP-50 polypeptide sequence through use of the genetic code. Computer programs such as "Back-Translate" (GCG™ Package, Acclerys, Inc. San Diego, Calif.) can be used to convert a peptide sequence to the corresponding nucleotide sequence encoding the peptide. Examples of PtIP-50 polypeptide sequences that can be used to obtain corresponding nucleotide encoding sequences include, but are not limited to the PtIP-50 polypeptides of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 and SEQ ID NO: 98. Furthermore, synthetic PtIP-50 polynucleotide sequences of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding a PtIP-50 polypeptide is a polynucleotide having the sequence set forth in SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 and SEQ ID NO: 70, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments the nucleic acid molecule encoding the PtIP-50 polypeptide or PtIP-65 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

In some embodiments the nucleic acid molecule encoding a PtIP-50 polypeptide is a the non-genomic polynucleotide having a nucleotide sequence having at least 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity, to the nucleic acid sequence of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 71, SEQ ID NO: 77, SEQ ID NO: 78, SEQ ID NO: 84 or SEQ ID NO: 96, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 72, SEQ ID NO: 73, SEQ ID NO: 74, SEQ ID NO: 79, SEQ ID NO: 85, SEQ ID NO: 89, SEQ ID NO: 93 or SEQ ID NO: 94, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 75, SEQ ID NO: 81, SEQ ID NO: 82, SEQ ID NO: 87 or SEQ ID NO: 98, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 76, SEQ ID NO: 80, SEQ ID NO: 88 or SEQ ID NO: 92, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 83, SEQ ID NO: 86, SEQ ID NO: 90 or SEQ ID NO: 91, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 97, wherein the PtIP-50 polypeptide, in combination with a PtIP-65 polypeptide, has insecticidal activity.

In some embodiments the nucleic acid molecule encodes a PtIP-50 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the any one of the amino acid sequences of SEQ ID NO: 224-326, wherein the PtIP-50 polypeptide, in combination with a PtIP-65 polypeptide, has insecticidal activity.

In some embodiments the nucleic acid molecule encodes a PtIP-50 polypeptide comprising an amino acid sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98.

In some embodiments the nucleic acid molecule encoding the PtIP-50 polypeptide is derived from a fern species in the Division *Pteridophyta*. The phylogeny of ferns as used herein is based on the classification for extant ferns by A. R. Smith et al, *TAXON*, 55:705-731 (2006). The consensus phylogeny based on the classification by A. R. Smith is shown in FIG. 1. Other phylogenic classifications of extant ferns are known to one skilled in the art. Additional information on the phylogeny of ferns can be found at mobot.org/MOBOT/research/APweb/ (which can be accessed using the "www" prefix) and Schuettpelz E. and Pryer K. M., *TAXON* 56: 1037-1050 (2007) based on three plastid genes. Additional fern and other primitive plant species can be found at homepages.caverock.net.nz/~byfern/list.htm (which can be accessed using the http:// prefix).

In some embodiments the nucleic acid molecule encoding the PtIP-50 polypeptide is derived from a fern species in the Class Psilotopsida. In some embodiments the nucleic acid molecule encoding the PtIP-50 polypeptide is derived from a fern species in the Class Psilotopsida, Order Psilotales. In some embodiments the nucleic acid molecule encoding PtIP-50 polypeptide is derived from a fern species in the Class Psilotopsida, Order Ophioglossales. In some embodiments the nucleic acid molecule encoding the PtIP-50 polypeptide is derived from a fern species in the Class Psilotopsida, Order Ophioglossales, Family Psilotaceae. In some embodiments the nucleic acid molecule encoding the PtIP-50 polypeptide is derived from a fern species in the Class Psilotopsida, Order Ophioglossales Family Ophioglossaceae. In some embodiments the nucleic acid molecule encoding the PtIP-50 polypeptide is derived from a fern species in the Genus *Ophioglossum* L., *Botrychium, Botrypus, Helminthostachys, Ophioderma, Cheiroglossa, Sceptridium* or *Mankyua*. In some embodiments the nucleic acid molecule encoding the PtIP-50 polypeptide is derived from a fern species in the *Ophioglossum* L. Genus is selected from but not limited to *Ophioglossum californicum, Ophioglossum coriaceum, Ophioglossum costatum, Ophioglossum crotalophoroides, Ophioglossum engelmannii, Ophioglossum falcatum, Ophioglossum gomezianum, Ophioglossum gramineum, Ophioglossum kawamurae, Ophioglossum lusitanicum, Ophioglossum namegatae, Ophioglossum nudicaule, Ophioglossum palmatum, Ophioglossum parvum, Ophioglossum pedunculosum, Ophioglossum pendulum, Ophioglossum petiolatum, Ophioglossum pusillum, Ophioglossum reticulatum, Ophioglossum richardsiae, Ophioglossum thermale*, and *Ophioglossum vulgatum*.

In some embodiments the nucleic acid molecule encoding the PtIP-50 polypeptide is derived from a species in the Class Polypodiopsida/Pteridopsida. In some embodiments the nucleic acid molecule encoding the PtIP-50 polypeptide is derived from a fern species in the Order Osmundales (royal ferns); Family Osmundaceae. In some embodiments the nucleic acid molecule encoding the PtIP-50 polypeptide is derived from a fern species in the Order Hymenophyllales (filmy ferns and bristle ferns); Family Hymenophyllaceae. In some embodiments the nucleic acid molecule encoding the PtIP-50 polypeptide is derived from a fern species in the Order Gleicheniales; Family Gleicheniaceae, Family Dipteridaceael or Family Matoniaceae. In some embodiments the nucleic acid molecule encoding the PtIP-50 polypeptide is derived from a fern species in the Order Schizaeales; Family Lygodiaceae, Family Anemiaceae or Family Schizaeaceae. In some embodiments the nucleic acid molecule encoding the PtIP-50 polypeptide is derived from a fern species in the Order Salviniales; Family Marsileaceae or Family Salviniaceae. In some embodiments the nucleic acid molecule encoding the PtIP-50 polypeptide is derived from a fern species in the Order Cyatheales; Family Thyrsopteridaceae, Family Loxsomataceae, Family Culcitaceae, Family Plagiogyriaceae, Family Cibotiaceae, Family Cyatheaceae, Family Dicksoniaceae or Family Metaxyaceae.

In some embodiments the nucleic acid molecule encoding the PtIP-50 polypeptide is derived from a fern species in the Order Polypodiales; Family Lindsaeaceae, Family Saccolomataceae, Family Cystodiaceae, Family Dennstaedtiaceae, Family Pteridaceae, Family Aspleniaceae, Family Thelypteridaceae, Family Woodsiaceae, Family Onocleaceae, Family Blechnaceae, Family Dryopteridaceae, Family Lomariopsidaceae, Family Tectariaceae, Family Oleandraceae, Family Davalliaceae or Family Polypodiaceae.

In some embodiments the nucleic acid molecule encoding the PtIP-50 polypeptide is derived from a fern species in the Order Polypodiales, Family Pteridaceae, Genus *Adiantaceae* selected from but not limited to *Adiantum aethiopicum, Adiantum aleuticum, Adiantum bonatianum, Adiantum cajennense, Adiantum capillus-junonis, Adiantum capillus-veneris, Adiantum caudatum, Adiantum chienfi, Adiantum chilense, Adiantum cuneatum, Adiantum cunninghamfi, Adiantum davidii, Adiantum diaphanum, Adiantum edentulum, Adiantum edgeworthfi, Adiantum excisum, Adiantum fengianum, Adiantum fimbriatum, Adiantum flabellulatum, Adiantum formosanum, Adiantum formosum, Adiantum fulvum, Adiantum gravesfi, Adiantum hispidulum, Adiantum induratum, Adiantum jordanfi, Adiantum juxtapositum, Adiantum latifolium, Adiantum leveillei, Adiantum lianxianense, Adiantum malesianum, Adiantum mariesfi, Adiantum monochlamys, Adiantum myriosorum, Adiantum obliquum, Adiantum ogasawarense, Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum venustum, Adiantum viridescens*, and *Adiantum viridimontanum*.

In some embodiments the nucleic acid molecule encoding the PtIP-50 polypeptide is derived from a fern species in the Order Polypodiales, Family Aspleniaceae, Genus *Asplenium* L. In some embodiments the nucleic acid molecule encoding the PtIP-50 polypeptide is derived from a fern species in the Order Polypodiales, Family Aspleniaceae, Genus *Asplenium* L selected from but not limited to *Asplenium abbreviatum, Asplenium abrotanoides, Asplenium abscissum* var. *subaequilaterale, Asplenium abscissum, Asplenium achilleifolium, Asplenium acuminatum, Asplenium adiantifrons, Asplenium adiantoides, Asplenium adiantoides* var. *squamulosum, Asplenium adiantum-nigrum* L., *Asplenium adiantum-nigrum* var. *adiantum-nigrum, Asplenium adiantum-nigrum* var. *yuanurn, Asplenium adnatum, Asplenium aethiopicum, Asplenium affine, Asplenium affine* var. *affine, Asplenium affine* var. *gilpinae, Asplenium affine* var. *mettenii, Asplenium affine* var. *pecten, Asplenium africanum, Asplenium afzelii, Asplenium aitchisonii, Asplenium alatulum, Asplenium alaturn, Asplenium alfredii, Asplenium altajense, Asplenium amabile, Asplenium ambohitantelense, Asplenium anceps* var. *proliferum, Asplenium andapense, Asplenium andersonii, Asplenium angustatum, Asplenium angustum, Asplenium anisophyllum, Asplenium annetii, Asplenium antiquum, Asplenium antrophyoides, Asplenium apertum, Asplenium apogamum, Asplenium aquaticum, Asplenium arboreum, Asplenium arcanum, Asplenium arcuaturn, Asplenium argentinum, Asplenium argutum, Asplenium aspidiiforme, Asplenium aspidioides, Asplenium asterolepis, Asplenium auricularium* var. *acutidens, Asplenium auricularium* var. *subintegerrimum, Asplenium auriculatum, Asplenium auriculatum* var. *aequilaterale, Asplenium auritum* fo. *diversifolium, Asplenium auritum* fo. *diversifolium, Asplenium auritum* fo. *nana, Asplenium auritum, Asplenium auritum* var. *auriculatum, Asplenium auritum* var. *auritum, Asplenium auritum* var. *bipinnatifidum, Asplenium auritum* var. *bipinnatisectum, Asplenium auritum* var. *davallioides, Asplenium auritum* var. *macilentum, Asplenium auritum* var. *rigidum, Asplenium auritum* var. *subsimplex, Asplenium austrochinense, Asplenium ayopayense, Asplenium badinii, Asplenium balense, Asplenium ballivianii, Asplenium bangii, Asplenium bangii, Asplenium barbaense, Asplenium barclayanum, Asplenium barkamense, Asplenium barteri, Asplenium basiscopicum, Asplenium bicrenatum, Asplenium bifrons, Asplenium bipartitum, Asplenium blastophorum, Asplenium blepharodes, Asplenium blepharophorum, Asplenium boiteaui, Asplenium bolivianurn, Asplenium boltonii, Asplenium borealichinense, Asplenium bradei, Asplenium bradeorum, Asplenium bradleyi, Asplenium brausei, Asplenium breedlovei, Asplenium buettneri, Asplenium buettneri* var. *hildebrandtii, Asplenium bulbiferum, Asplenium bullatum* var. *bullatum, Asplenium bullatum* var. *shikokianum, Asplenium bullatum, Asplenium cancellatum, Asplenium capillipes, Asplenium cardiophyllum* (Hance), *Asplenium caripense, Asplenium carvalhoanurn, Asplenium castaneoviride, Asplenium castaneum, Asplenium caudatum, Asplenium celtidifolium* (Kunze), *Asplenium ceratolepis, Asplenium changputungense, Asplenium chaseanum, Asplenium cheilosorum, Asplenium chengkouense, Asplenium chihuahuense, Asplenium chimantae, Asplenium chimborazense, Asplenium chingianurn, Asplenium chlorophyllum, Asplenium chondrophyllum, Asplenium cicutarium, Asplenium cicutarium* var. *paleaceum, Asplenium cirrhatum, Asplenium cladolepton, Asplenium claussenii, Asple-* nium coenobiale, Asplenium commutatum, Asplenium congestum, Asplenium conquisitum, Asplenium consimile, Asplenium contiguum, Asplenium contiguum var. hirtulum, Asplenium corderoi, Asplenium cordovense, Asplenium coriaceum, Asplenium coriifolium, Asplenium correardii, Asplenium costale, Asplenium costale var. robustum, Asplenium cowanii, Asplenium crenulatoserrulatum, Asplenium crenulatum, Asplenium crinicaule, Asplenium crinulosum, Asplenium cristatum, Asplenium cryptolepis Fernald, Asplenium cultrifolium L., Asplenium cuneatiforme, Asplenium cuneaturn, Asplenium curvatura, Asplenium cuspidaturn, Asplenium cuspidatum var cuspidatum, Asplenium cuspidatum var. foeniculaceum, Asplenium cuspidatum var. triculum, Asplenium cuspidatum var. tripinnaturn, Asplenium dalhousiae, Asplenium dareoides, Asplenium davallioides, Asplenium davisii, Asplenium debile, Asplenium debile, Asplenium decussatum, Asplenium delavayi, Asplenium delicatulum, Asplenium delicatulum var. cocosensis, Asplenium delitescens, Asplenium delitescens×laetum, Asplenium densum, Asplenium dentatum L., Asplenium dentatum L., Asplenium depauperaturn, Asplenium deqenense, Asplenium dianae, Asplenium difforme, Asplenium dilataturn, Asplenium dimidiatum, Asplenium dimidiatum var. boliviense, Asplenium diplazisorum, Asplenium dissectum, Asplenium distans, Asplenium divaricatum, Asplenium divergens, Asplenium divisissimum, Asplenium doederleinii, Asplenium donnell-smithii, Asplenium dregeanum, Asplenium dulongjiangense, Asplenium duplicatoserratum, Asplenium eatonii, Asplenium ebeneum, Asplenium ebenoides, Asplenium ecuadorense, Asplenium eggersii, Asplenium emarginatum, Asplenium enaturn, Asplenium ensiforme fo. bicuspe, Asplenium ensiforme fo. ensiforme, Asplenium ensiforme fo. stenophyllum, Asplenium ensiforme, Asplenium erectum var. erectum, Asplenium erectum var. gracile, Asplenium erectum var. usambarense, Asplenium erectum var. zeyheri, &, Asplenium erosum L., Asplenium escaleroense, Asplenium esculentum, Asplenium eutecnum, Asplenium excelsum, Asplenium excisum, Asplenium exiguum, Asplenium extensum, Asplenium falcaturn, Asplenium falcinellum, Asplenium faurei, Asplenium feel, Asplenium fengyangshanense, Asplenium ferulaceum, Asplenium fibrillosum, Asplenium filix-femina, Asplenium finckii, Asplenium finlaysonianurn, Asplenium flabellulatum, Asplenium flabellulatum var flabellulatum, Asplenium flabellulatum var. partitum, Asplenium flaccidum, Asplenium flavescens, Asplenium flavidum, Asplenium flexuosum, Asplenium fluminense, Asplenium foeniculaceum, Asplenium formosanum, Asplenium formosum var. carolinurn, Asplenium formosum var. incultum, Asplenium formosum, Asplenium foumieri, Asplenium fragile, Asplenium fragile var. lomense, Asplenium fragrans, Asplenium fragrans var. foeniculaceum, Asplenium franconis var. gracile, Asplenium fraxinifolium, Asplenium friesiorum, Asplenium friesiorum var. nesophilum, Asplenium fugax, Asplenium fujianense, Asplenium furcatum, Asplenium furfuraceum, Asplenium fuscipes, Asplenium fuscopubescens, Asplenium galeottii, Asplenium gautieri, Asplenium gemmiferum, Asplenium gentryi, Asplenium geppii, Asplenium ghiesbreghtii, Asplenium gilliesii, Asplenium gilpinae, Asplenium glanduliserraturn, Asplenium glenniei, Asplenium goldmannii, Asplenium gomezianurn, Asplenium grande, Asplenium grandifolium, Asplenium grandifrons, Asplenium gregoriae, Asplenium griffithianum, Asplenium gulingense, Asplenium hainanense, Asplenium hallbergii, Asplenium hallei, Asplenium hallii, Asplenium hangzhouense, Asplenium haplophyllum, Asplenium harpeodes, Asplenium harpeodes var. glaucovirens, Asplenium harpeodes var. incisura, Asplenium harrisii Jenman, Asplenium harrisonii, Asplenium hastatum, Asplenium hebeiense, Asplenium hemionitideum, Asplenium hemitomurn, Asplenium henryi, Asplenium herpetopteris, Asplenium herpetopteris var herpetopteris, Asplenium herpetopteris var. acutipinnata, Asplenium herpetopteris var. masoulae, Asplenium herpetopteris var. villosum, Asplenium hesperium, Asplenium heterochroum, Asplenium hians, Asplenium hians var. pallescens, Asplenium hoffmannii, Asplenium holophlebium, Asplenium hondoense, Asplenium horridum, Asplenium hostmannii, Asplenium humistratum, Asplenium hypomelas, Asplenium inaequilaterale, Asplenium incisura, Asplenium incurvaturn, Asplenium indicum, Asplenium indicum var. indicum, Asplenium indicum var. yoshingagae, Asplenium induratum, Asplenium indusiatum, Asplenium inexpectatum, Asplenium insigne, Asplenium insiticium, Asplenium insolitum, Asplenium integerrimurn, Asplenium interjectum, Asplenium jamesonii, Asplenium jaundeense, Asplenium juglandifolium, Asplenium kangdingense, Asplenium kansuense, Asplenium kassneri, Asplenium kaulfussii, Asplenium kellermanii, Asplenium kentuckiense, Asplenium khullarii, Asplenium kiangsuense, Asplenium kunzeanurn, Asplenium lacerum, Asplenium laciniatum, Asplenium laciniatum var. acutipinna, Asplenium laciniatum var. laciniatum, Asplenium laetum fo. minor, Asplenium laetum, Asplenium laetum var. incisoserratum, Asplenium lamprocaulon, Asplenium laserpitiifolium var. morrisonense, Asplenium lastii, Asplenium latedens, Asplenium latifolium, Asplenium laui, Asplenium laurentii, Asplenium leandrianurn, Asplenium lechleri, Asplenium leiboense, Asplenium lepidorachis, Asplenium leptochlamys, Asplenium leptophyllum, Asplenium levyi, Asplenium lindbergii, Asplenium lindeni, Asplenium lineatum, Asplenium lividum, Asplenium lobatum, Asplenium lobulaturn, Asplenium lokohoense, Asplenium longicauda, Asplenium longicaudaturn, Asplenium longifolium, Asplenium longisorum, Asplenium longjinense, Asplenium lorentzii, Asplenium loriceum, Asplenium loxogrammoides, Asplenium lugubre, Asplenium lunulatum, Asplenium lunulatum var. pteropus, Asplenium lushanense, Asplenium lydgatei, Asplenium macilentum, Asplenium macraei, Asplenium macrodictyon, Asplenium macrophlebium, Asplenium macrophyllum, Asplenium macropterum, Asplenium macrosorum, Asplenium macrotis, Asplenium macrurum, Asplenium mainlingense, Asplenium mangindranense, Asplenium mannii, Asplenium marginatum L., Asplenium marojejyense, Asplenium martianum, Asplenium matsumurae, Asplenium mauritiensis Lorence, Asplenium maximum, Asplenium, ii, Asplenium megalura, Asplenium megaphyllum, Asplenium meiotomum, Asplenium melanopus, Asplenium membranifolium, Asplenium meniscioides, Asplenium mesosorum, Asplenium mexicanum, Asplenium micropaleatum, Asplenium microtum, Asplenium mildbraedii, Asplenium mildei, Asplenium minimum, Asplenium minutum, Asplenium miradorense, Asplenium miyunense, Asplenium moccenianum, Asplenium mocquetysii, Asplenium modestum, Asplenium monanthemum var. menziesii, Asplenium monanthes L., Asplenium monanthes var monanthes, Asplenium monanthes var. castaneum, Asplenium monanthes var. wagneri, Asplenium monanthes var. yungense, Asplenium monodon, Asplenium montanum, Asplenium mosetenense, Asplenium moupinense, Asplenium mucronatum, Asplenium munchii, Asplenium muticum, Asplenium myapteron, Asplenium myriophyllu, Asplenium nakanoanum, Asplenium nanchuanense, Asplenium nemorale, Asplenium neolaserpitiifolium, Asplenium neomutijugum, Asplenium neovarians, Asplenium nesii, Asplenium nesioticum, Asplenium nidus L., Asplenium nigricans, Asplenium niponicum, Asplenium normale, Asplenium normale var.

*angustum, Asplenium obesum, Asplenium oblongatum, Asplenium oblongifolium, Asplenium obovatum, Asplenium obscurum, Asplenium obscurum* var. *angustum, Asplenium obtusatum* var. *obtusatum, Asplenium obtusatum* var. *sphenoides, Asplenium obtusifolium* L., *Asplenium obtusissimum, Asplenium obversum, Asplenium ochraceum, Asplenium oellgaardii, Asplenium ofeliae, Asplenium oldhami, Asplenium oligosorum, Asplenium olivaceum, Asplenium onopteris* L., *Asplenium onustum, Asplenium ortegae, Asplenium otites, Asplenium palaciosii, Asplenium palmeri, Asplenium partitum, Asplenium parvisorum, Asplenium parviusculum, Asplenium parvulum, Asplenium patens, Asplenium paucifolium, Asplenium paucijugum, Asplenium paucivenosum, Asplenium pearcei, Asplenium pekinense, Asplenium pellucidum, Asplenium pendulum, Asplenium petiolulatum, Asplenium phyllitidis, Asplenium pimpinellifolium, Asplenium pinnatifidum, Asplenium pinnatum, Asplenium platyneuron, Asplenium platyneuron* var. *bacculumrubrum, Asplenium platyneuron* var. *incisum, Asplenium platyphyllum, Asplenium plumbeum, Asplenium poloense, Asplenium polymeris, Asplenium polymorphum, Asplenium polyodon, Asplenium polyodon* var. *knudsenii, Asplenium polyodon* var. *nitidulum, Asplenium polyodon* var. *sectum, Asplenium polyodon* var. *subcaudatum, Asplenium polyphyllum, Asplenium poolii, Asplenium poolii* fo. *simplex, Asplenium poolii* var. *linearipinnatum, Asplenium potosinum, Asplenium potosinum* var. *incisum, Asplenium praegracile, Asplenium praemorsum, Asplenium preussii, Asplenium pringleanum, Asplenium pringlei, Asplenium prionitis, Asplenium procerum, Asplenium progrediens, Asplenium projectum, Asplenium prolongatum, Asplenium propinquum, Asplenium protensum, Asplenium pseudoangustum, Asplenium pseudoerectum, Asplenium pseudofontanum, Asplenium pseudolaserpitiifolium, Asplenium pseudonormale, Asplenium pseudo pellucidum, Asplenium pseudopraemorsum, Asplenium pseudovarians, Asplenium pseudowilfordii, Asplenium pseudowrightii, Asplenium psilacrum, Asplenium pteropus, Asplenium pubirhizoma, Asplenium pulchellum, Asplenium pulchellum* var. *subhorizontale, Asplenium pulcherrimum, Asplenium pulicosum, Asplenium pulicosum* var. *maius, Asplenium pululahuae, Asplenium pumilum, Asplenium pumilum* var. *hymenophylloides, Asplenium pumilum* var. *laciniatum, Asplenium purdieanum, Asplenium purpurascens, Asplenium pyramidatum, Asplenium qiujiangense, Asplenium quercicola, Asplenium quitense, Asplenium raddianum, Asplenium radiatum, Asplenium radicans* L., *Asplenium radicans, Asplenium radicans* var. *costaricense, Asplenium radicans* var. *partitum, Asplenium radicans* var. *radicans, Asplenium radicans* var. *uniseriale, Asplenium recumbens, Asplenium reflexum, Asplenium regulare* var. *latior, Asplenium repandulum, Asplenium repens, Asplenium repente, Asplenium resiliens, Asplenium retusulum, Asplenium rhipidoneuron, Asplenium rhizophorum* L., *Asplenium rhizophyllum, Asplenium rhizophyllum* L., *Asplenium rhizophyllum* var. *proliferum, Asplenium rhomboideum, Asplenium rigidum, Asplenium riparium, Asplenium rivale, Asplenium rockii, Asplenium roemerianum, Asplenium roemerianum* var. *mindensis, Asplenium rosenstockianum, Asplenium rubinum, Asplenium ruizianum, Asplenium rusbyanum, Asplenium ruta-muraria* L., *Asplenium ruta-muraria* var. *cryptolepis, Asplenium rutaceum, Asplenium rutaceum* var. *disculiferum, Asplenium rutaefolium, Asplenium rutifolium, Asplenium salicifolium* L., *Asplenium salicifolium, Asplenium salicifolium* var. *aequilaterale, Asplenium salicifolium, Asplenium sampsoni, Asplenium sanchezii, Asplenium sanderi, Asplenium sandersonii, Asplenium sanguinolentum, Asplenium sarelii, Asplenium sarelii* var. *magnum, Asplenium sarelii* var. *sarelii, Asplenium saxicola, Asplenium scalifolium, Asplenium scandicinum, Asplenium schizophyllum, Asplenium schkuhrii, Asplenium sciadophilum, Asplenium scolopendrium* L., *Asplenium scortechinii, Asplenium seileri, Asplenium semipinnatum, Asplenium septentrionale, Asplenium serra, Asplenium serra* var. *imrayanum, Asplenium serratissimum, Asplenium serratum* L., *Asplenium serratum* var. *caudatum, Asplenium serricula, Asplenium sessilifolium, Asplenium sessilifolium* var. *guatemalense, Asplenium sessilifolium* var. *minus, Asplenium sessilifolium* var. *occidentale, Asplenium sessilipinnum, Asplenium setosum, Asplenium shepherdii, Asplenium shepherdii* var. *bipinnatum, Asplenium shepherdii* var. *flagelliferum, Asplenium shikokianum, Asplenium simii, Asplenium simonsianum, Asplenium sintenisii, Asplenium skinneri, Asplenium skinneri, Asplenium sodiroi, Asplenium soleirolioides, Asplenium solidum* var. *stenophyllum, Asplenium solmsii, Asplenium* sp.-N.-Halle-2234, *Asplenium spathulinum, Asplenium spectabile, Asplenium speluncae, Asplenium sphaerosporum, Asplenium sphenotomurn, Asplenium spinescens, Asplenium splendens, Asplenium sprucei, Asplenium squamosum* L., *Asplenium standleyi, Asplenium stellatum, Asplenium stenocarpum, Asplenium stoloniferum, Asplenium stolonipes, Asplenium striatum* L., *Asplenium stuebelianum, Asplenium stuhlmannii, Asplenium suave, Asplenium subalatum, Asplenium subcrenaturn, Asplenium subdigitatum, Asplenium subdimidiatum, Asplenium subintegrum, Asplenium sublaserpitfifolium, Asplenium sublongum, Asplenium subnudum, Asplenium suborbiculare, Asplenium subtenuifolium, Asplenium subtile, Asplenium subtoramanurn, Asplenium subtrapezoideum, Asplenium subvarians, Asplenium sulcatum, Asplenium sylvaticum, Asplenium szechuanense, Asplenium taiwanense, Asplenium tenerrimum, Asplenium tenerum, Asplenium tenuicaule, Asplenium tenuifolium, Asplenium tenuifolium* var. *minor, Asplenium tenuifolium* var. *tenuifolium, Asplenium tenuissimum, Asplenium ternatum, Asplenium theciferum, Asplenium theciferum* var. *concinnum, Asplenium thunbergii, Asplenium tianmushanense, Asplenium tianshanense, Asplenium tibeticum, Asplenium tocoraniense, Asplenium toramanurn, Asplenium trapezoideum, Asplenium tricholepis, Asplenium trichomanes* L., *Asplenium trichomanes* subsp. *inexpectans, Asplenium trichomanes* subsp. *quadrivalens, Asplenium trichomanes* subsp. *trichomanes, Asplenium trichomanes* var. *harovii, Asplenium trichomanes* var. *herbaceum, Asplenium trichomanes* var. *repens, Asplenium trichomanes* var. *viridissimum, Asplenium trichomanes-dentatum* L., *Asplenium trigonopterum, Asplenium trilobatum, Asplenium trilobum, Asplenium triphyllum, Asplenium triphyllum* var. *cornpactum, Asplenium triphyllum* var. *gracillimum, Asplenium triphyllum* var. *herbaceum, Asplenium tripteropus, Asplenium triquetrum, Asplenium truncorum, Asplenium tsaratananense, Asplenium tucumanense, Asplenium tuerckheimii, Asplenium tunquiniense, Asplenium ulbrichtii, Asplenium ultimurn, Asplenium unilaterale, Asplenium unilaterale* var. *decurrens, Asplenium unilaterale* var. *udum, Asplenium unilaterale* var. *unilaterale, Asplenium uniseriale, Asplenium uropteron, Asplenium vegans, Asplenium vareschianum, Asplenium variabile* var. *paucijugum, Asplenium variabile* var. *variabile, Asplenium varians* subsp. *fimbriatum, Asplenium varians, Asplenium vastum, Asplenium venturae, Asplenium venulosum, Asplenium verapax, Asplenium vesiculosum, Asplenium vespertinurn, Asplenium villosum, Asplenium virens, Asplenium viride, Asplenium viridifrons, Asplenium virillae, Asplenium vivipariodies, Asplenium viviparum, Asplenium viviparum* var *viviparum, Asplenium viviparum* var. *lineatu, Asplenium*

*volubile, Asplenium vulcanicum, Asplenium wacketii, Asplenium wagneri, Asplenium wallichianum, Asplenium wameckei, Asplenium wilfordii, Asplenium williamsii, Asplenium wrightii, Asplenium wrightioides, Asplenium wuliangshanense, Asplenium xianqianense, Asplenium xinjiangense, Asplenium xinyiense, Asplenium yelagagense, Asplenium yoshinagae, Asplenium yunnanense, Asplenium zamiifolium, Asplenium zanzibaricum, Asplenium biscayneanum, Asplenium curtissii, Asplenium ebenoides, Asplenium herb-wagneri, Asplenium heteroresiliens, Asplenium kenzoi, Asplenium plenum, Asplenium wangii,* and *Asplenium×clermontiae, Asplenium×gravesii.*

In some embodiments the nucleic acid molecule encoding the PtIP-50 polypeptide is derived from a fern species in the Order Polypodiales, Family Blechnaceae, Genus *Blechnum* L. In some embodiments the nucleic acid molecule encoding the PtIP-50 polypeptide is derived from a fern species in the Order Polypodiales, Family Blechnaceae, Genus *Blechnum* L. selected from but not limited to *Blechnum amabile, Blechnum appendiculatum, Blechnum articulatum, Blechnum australe, Blechnum austrobrasilianum, Blechnum binervatum, Blechnum blechnoides, Blechnum brasiliense, Blechnum capense, Blechnum cartilagineum, Blechnum castaneum, Blechnum chambersii, Blechnum chilense, Blechnum colensoi, Blechnum contiguum, Blechnum cordatum, Blechnum coriaceum, Blechnum discolor, Blechnum doodioides, Blechnum durum, Blechnum eburneum, Blechnum ensiforme, Blechnum filiforme, Blechnum fluviatile, Blechnum fragile, Blechnum fraseri, Blechnum fullagari, Blechnum gibbum, Blechnum glandulosum, Blechnum gracile, Blechnum hancockii, Blechnum hastatum, Blechnum howeanum, Blechnum indicum, Blechnum kunthianum, Blechnum laevigatum, Blechnum loxense, Blechnum magellanicum, Blechnum membranaceum, Blechnum microbasis, Blechnum microphyllum, Blechnum milnei, Blechnum minus, Blechnum mochaenum, Blechnum montanum, Blechnum moorei, Blechnum moritzianum, Blechnum nigrum, Blechnum niponicum, Blechnum norfolkianum, Blechnum novaezelandiae, Blechnum nudum, Blechnum obtusatum, Blechnum occidentale, Blechnum oceanicum, Blechnum orientale, Blechnum patersonii, Blechnum penna-marina, Blechnum polypodioides, Blechnum procerum, Blechnum punctulatum, Blechnum sampaioanum, Blechnum schiedeanum, Blechnum schomburgkii, Blechnum serrulatum, Blechnum simillimum, Blechnum spicant, Blechnum stipitellatum, Blechnum tabulare, Blechnum triangularifolium, Blechnum vieillardii, Blechnum vulcanicum, Blechnum wattsii, Blechnum whelanii,* and *Blechnum wurunuran.*

In some embodiments the nucleic acid molecule encoding the PtIP-50 polypeptide is derived from a fern species in the Order Polypodiales, Family Dryopteridaceae Genus *Acrophorus,* Genus *Acrorumohra,* Genus *Anapausia,* Genus *Arachniodes,* Genus *Bolbitis,* Genus *Ctenitis,* Genus *Cyclodium,* Genus *Cyrtogonellum,* Genus *Cyrtomidictyum,* Genus *Cyrtomium,* Genus *Diacalpe,* Genus *Didymochlaena,* Genus *Dryopsis,* Genus *Dryopteris,* Genus *Elaphoglossum,* Genus *Hypodematium,* Genus *Lastreopsis,* Genus *Leptorumohra,* Genus *Leucostegia,* Genus *Lithostegia,* Genus *Lomagramma,* Genus *Maxonia,* Genus *Megalastrum,* Genus *Olfersia,* Genus *Peranema,* Genus *Phanerophlebia,* Genus *Phanerophlebiopsis,* Genus *Polybotrya,* Genus *Polystichopsis,* Genus *Polystichum,* Genus *Rumohra,* Genus *Sorolepidium,* Genus *Stigmatopteris* or Genus *Teratophyllum.* In some embodiments the nucleic acid molecule encoding the PtIP-50 polypeptide is derived from a fern species in the Order Polypodiales, Family Dryopteridaceae, Genus *Bolbitis,* selected from but not limited to *Bolbitis acrostichoides, Bolbitis aliena, Bolbitis angustipinna, Bolbitis appendiculata, Bolbitis auriculata, Bolbitis bemoullii, Bolbitis bipinnatifida, Bolbitis cadieri, Bolbitis christensenfi, Bolbitis confertifolia, Bolbitis costata, Bolbitis crispatula, Bolbitis fluviatilis, Bolbitis gaboonensis, Bolbitis gemmifera, Bolbitis hainanensis, Bolbitis hastata, Bolbitis hekouensis, Bolbitis hemiotis, Bolbitis heteroclita, Bolbitis heudelotii, Bolbitis humblotii, Bolbitis interlineata, Bolbitis latipinna, Bolbitis laxireticulata, Bolbitis lindigfi, Bolbitis lonchophora, Bolbitis longiflagellata, Bolbitis major, Bolbitis media, Bolbitis nicotianifolia, Bolbitis nodiflora, Bolbitis novoguineensis, Bolbitis oligarchica, Bolbitis palustris, Bolbitis pandurifolia, Bolbitis pergamentacea, Bolbitis portoricensis, Bolbitis presliana, Bolbitis quoyana, Bolbitis rawsonfi, Bolbitis repanda, Bolbitis rhizophylla, Bolbitis riparia, Bolbitis rivularis, Bolbitis sagenioides, Bolbitis salicina, Bolbitis scalpturata, Bolbitis scandens, Bolbitis semicordata, Bolbitis semipinnatifida, Bolbitis serrata, Bolbitis serratifolia, Bolbitis simplex, Bolbitis sinensis, Bolbitis singaporensis, Bolbitis sinuata, Bolbitis subcordata, Bolbitis subcrenata, Bolbitis taylorii, Bolbitis tibetica, Bolbitis tonkinensis, Bolbitis umbrosa, Bolbitis vanuaensis,* and *Bolbitis virens.*

In some embodiments the nucleic acid molecule encoding the PtIP-50 polypeptide is derived from a fern species in the Order Polypodiales, Family Lomariopsidaceae, Genus *Nephrolepis.* In some embodiments the nucleic acid molecule encoding the PtIP-50 polypeptide is derived from a fern species in the Order Polypodiales, Family Lomariopsidaceae, Genus *Nephrolepis* is selected from but not limited to *Nephrolepis abrupta, Nephrolepis acuminata, Nephrolepis acutifolia, Nephrolepis arida, Nephrolepis arthropteroides, Nephrolepis biserrata* var. *auriculata, Nephrolepis brownii, Nephrolepis celebica, Nephrolepis clementis, Nephrolepis cordifolia, Nephrolepis davalliae, Nephrolepis davallioides, Nephrolepis dayakorum, Nephrolepis delicatula, Nephrolepis dicksonioides, Nephrolepis duffii, Nephrolepis exaltata* ssp. *exaltata* ssp. *Hawaiiensis, Nephrolepis falcata, Nephrolepis falciformis, Nephrolepis glabra, Nephrolepis hirsutula, Nephrolepis humatoides, Nephrolepis iridescens, Nephrolepis kurotawae, Nephrolepis laurifolia, Nephrolepis lauterbachii, Nephrolepis lindsayae, Nephrolepis multifida, Nephrolepis multiflora, Nephrolepis niphoboloides, Nephrolepis obliterate, Nephrolepis paludosa, Nephrolepis pectinata, Nephrolepis pendula, Nephrolepis persicifolia, Nephrolepis pickelii, Nephrolepis pilosula, Nephrolepis pubescens, Nephrolepis pumicicola, Nephrolepis radicans, Nephrolepis rivularis, Nephrolepis rosenstockii, Nephrolepis saligna, Nephrolepis schlechteri, Nephrolepis serrate, Nephrolepis thomsoni, Nephrolepis undulata* var. *aureoglandulosa, Nephrolepis×averyi, Nephrolepis×copelandii,* and *Nephrolepis×medlerae.*

In some embodiments the nucleic acid molecule encoding the PtIP-50 polypeptide is derived from a fern species in the Order Polypodiales, Family Polypodiaceae, Genus *Campyloneurum,* Genus *Drynaria,* Genus *Lepisorus,* Genus *Microgramma,* Genus *Microsorum,* Genus *Neurodium,* Genus *Niphidium,* Genus *Pecluma* M.G., Genus *Phlebodium,* Genus *Phymatosorus,* Genus *Platycerium,* Genus *Pleopeltis,* Genus *Polypodium* L.

In some embodiments the nucleic acid molecule encoding the PtIP-50 polypeptide is derived from a fern species in the Order Polypodiales, Family Polypodiaceae, Genus *Polypodium* L. In some embodiments the nucleic acid molecule encoding the PtIP-50 polypeptide is derived from a fern species in the Order Polypodiales, Family Polypodiaceae, Genus *Polypodium* L. selected from but not limited to

*Polypodium absidatum, Polypodium acutifolium, Polypodium adiantiforme, Polypodium aequale, Polypodium affine, Polypodium albidopaleatum, Polypodium alcicorne, Polypodium alfarii, Polypodium alfredii, Polypodium alfredii* var. *curtii, Polypodium allosuroides, Polypodium alsophilicola, Polypodium amamianum, Polypodium amoenum, Polypodium amorphum, Polypodium anetioides, Polypodium anfractuosum, Polypodium anguinum, Polypodium angustifolium* f. *remotifolia, Polypodium angustifolium* var. *amphostenon, Polypodium angustifolium* var. *heterolepis, Polypodium angustifolium* var. *monstrosa, Polypodium angustipaleatum, Polypodium angustissimum, Polypodium anisomeron* var. *pectinatum, Polypodium antioquianum, Polypodium aoristisorum, Polypodium apagolepis, Polypodium apicidens, Polypodium apiculatum, Polypodium apoense, Polypodium appalachianum, Polypodium appressum, Polypodium arenarium, Polypodium argentinum, Polypodium argutum, Polypodium armaturn, Polypodium aromaticum, Polypodium aspersum, Polypodium assurgens, Polypodium atrum, Polypodium auriculatum, Polypodium balaonense, Polypodium balliviani, Polypodium bamleri, Polypodium bangii, Polypodium bartlettii, Polypodium basale, Polypodium bemoullii, Polypodium biauritum, Polypodium bifrons, Polypodium blepharodes, Polypodium bolivari, Polypodium bolivianurn, Polypodium bolobense, Polypodium bombycinum, Polypodium bombycinum* var. *insularum, Polypodium bradeorum, Polypodium bryophilum, Polypodium bryopodum, Polypodium buchtienii, Polypodium buesii, Polypodium bulbotrichum, Polypodium caceresii, Polypodium californicum* f. *brauscombii, Polypodium californicum* f. *parsonsiae, Polypodium californicum, Polypodium calophlebium, Polypodium calvum, Polypodium camptophyllarium* var. *abbreviatum, Polypodium capitellatum, Polypodium carpinterae, Polypodium chachapoyense, Polypodium chartaceum, Polypodium chimantense, Polypodium chiricanum, Polypodium choquetangense, Polypodium christensenii, Polypodium christii, Polypodium chrysotrichum, Polypodium ciliolepis, Polypodium cinerascens, Polypodium collinsii, Polypodium colysoides, Polypodium confluens, Polypodium conforme, Polypodium confusum, Polypodium congregatifolium, Polypodium connellii, Polypodium consimile* var. *bourgaeanum, Polypodium consimile* var. *minor, Polypodium conterminans, Polypodium contiguum, Polypodium cookii, Polypodium coriaceum, Polypodium coronans, Polypodium costaricense, Polypodium costatum, Polypodium crassifolium* f. *angustissimum, Polypodium crassifolium* var. *longipes, Polypodium crassulum, Polypodium craterisorum, Polypodium cryptum, Polypodium crystalloneuron, Polypodium cucullaturn* var. *planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeranum, Polypodium denticulatum, Polypodium diaphanum, Polypodium dilataturn, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis* var. *villosum, Polypodium exornans, Polypodium falcoideum, Polypodium fallacissimum, Polypodium farinosum, Polypodium faucium, Polypodium feel, Polypodium ferrugineum, Polypodium feuillei, Polypodium firmulum, Polypodium firmum, Polypodium flaccidum, Polypodium flagellare, Polypodium flexuosum, Polypodium flexuosum* var. *ekmanii, Polypodium forbesii, Polypodium formosanum, Polypodium fraxinifolium* subsp. *articulatum, Polypodium fraxinifolium* subsp. *luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum* var. *simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens* var. *subdentatum, Polypodium insidiosum, Polypodium insigne, Polypodium intermedium* subsp. *masafueranum* var. *obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri* var. *costaricense, Polypodium lachniferum* f. *incurvata, Polypodium lachniferum* var. *glabrescens, Polypodium lachnopus, Polypodium lanceolatum* var. *complanatum, Polypodium lanceolatum* var. *trichophorum, Polypodium latevagans, Polypodium laxifrons, Polypodium laxifrons* var. *lividum, Polypodium lehmannianum, Polypodium leiorhizum, Polypodium leptopodon, Polypodium leuconeuron* var. *angustifolia, Polypodium leuconeuron* var. *latifolium, Polypodium leucosticta, Polypodium limulum, Polypodium lindigii, Polypodium lineatum, Polypodium lomarioides, Polypodium longifrons, Polypodium loretense, Polypodium loriceum* var. *umbraticum, Polypodium loriforme, Polypodium loxogramme* f. *gigas, Polypodium ludens, Polypodium luzonicum, Polypodium lycopodioides* f. *obtusum, Polypodium lycopodioides* L., *Polypodium macrolepis, Polypodium macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalepis, Polypodium melanotrichum, Polypodium menisciifolium* var. *pubescens, Polypodium meniscioides, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme* var. *minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum* var. *latior, Polypodium nubrigenum, Polypodium oligolepis, Polypodium oligosorum, Polypodium oligosorum, Polypodium olivaceum, Polypodium olivaceum* var. *elatum, Poly-*

*podium oodes, Polypodium oosphaerum, Polypodium oreophilum, Polypodium ornatissimum, Polypodium ornatum, Polypodium ovatum, Polypodium oxylobum, Polypodium oxypholis, Polypodium pakkaense, Polypodium pallidum, Polypodium palmatopedatum, Polypodium palmeri, Polypodium panamense, Polypodium parvum, Polypodium patagonicum, Polypodium paucisorum, Polypodium pavonianum, Polypodium pectinatum* var. *caliense, Polypodium pectinatum* var. *hispidum, Polypodium pellucidum, Polypodium pendulum* var. *boliviense, Polypodium percrassum, Polypodium perpusillum, Polypodium peruvianum* var. *subgibbosum, Polypodium phyllitidis* var. *elongatum, Polypodium pichinchense, Polypodium pilosissimum, Polypodium pilosissimum* var. *glabriusculum, Polypodium pilossimum* var. *tunguraquensis, Polypodium pityrolepis, Polypodium platyphyllum, Polypodium playfairii, Polypodium plebeium* var. *cooperi, Polypodium plectolepidioides, Polypodium pleolepis, Polypodium plesiosorum* var.i, *Polypodium podobasis, Polypodium podocarpum, Polypodium poloense, Polypodium polydatylon, Polypodium polypodioides* var. *aciculare, Polypodium polypodioides* var. *michauxianum, Polypodium praetermissum, Polypodium preslianum* var. *immersum, Polypodium procerum, Polypodium procerum, Polypodium productum, Polypodium productum, Polypodium prolongilobum, Polypodium propinguum, Polypodium proteus, Polypodium pruinatum, Polypodium pseudocapillare, Polypodium pseudofratemum, Polypodium pseudonutans, Polypodium pseudoserratum, Polypodium pulcherrimum, Polypodium pulogense, Polypodium pungens, Polypodium purpusii, Polypodium radicale, Polypodium randallii, Polypodium ratiborii, Polypodium reclinaturn, Polypodium recreense, Polypodium repens* var. *abruptum, Polypodium revolvens, Polypodium rhachipterygium, Polypodium rhomboideum, Polypodium rigens, Polypodium robustum, Polypodium roraimense, Polypodium roraimense, Polypodium rosei, Polypodium rosenstockii, Polypodium rubidum, Polypodium rudimentum, Polypodium rusbyi, Polypodium sablanianum, Polypodium sarmentosum, Polypodium saxicola, Polypodium schenckii, Polypodium schlechteri, Polypodium scolopendria, Polypodium scolopendria, Polypodium scolopendrium, Polypodium scouleri, Polypodium scutulatum, Polypodium segregatum, Polypodium semihirsutum, Polypodium semihirsutum* var. *fuscosetosum, Polypodium senile* var. *minor, Polypodium sericeolanatum, Polypodium serraeforme, Polypodium serricula, Polypodium sesquipedala, Polypodium sessilifolium, Polypodium setosum* var. *calvum, Polypodium setulosum, Polypodium shaferi, Polypodium sibomense, Polypodium siccum, Polypodium simacense, Polypodium simulans, Polypodium singeri, Polypodium sinicum, Polypodium sintenisii, Polypodium skutchii, Polypodium sloanei, Polypodium sodiroi, Polypodium sordidulum, Polypodium sordidum, Polypodium sphaeropteroides, Polypodium sphenodes, Polypodium sprucei, Polypodium sprucei* var. *furcativenosa, Polypodium steirolepis, Polypodium stenobasis, Polypodium stenolepis, Polypodium stenopterum, Polypodium subcapillare, Polypodium subflabelliforme, Polypodium subhemionitidium, Polypodium subinaequale, Polypodium subintegrum, Polypodium subspathulatum, Polypodium subtile, Polypodium subvestitum, Polypodium subviride, Polypodium superficiale* var. *attenuatum, Polypodium superficiale* var. *chinensis, Polypodium sursumcurrens, Polypodium tablazianurn, Polypodium taenifolium, Polypodium tamandarei, Polypodium tatei, Polypodium tenuiculum* var. *acrosora, Polypodium tenuiculum* var. *brasiliense, Polypodium tenuilore, Polypodium tenuinerve, Polypodium tepuiense, Polypodium teresae, Polypodium tetragonum* var. *incompletum, Polypodium thysanolepis* var. *bipinnatifidum, Polypodium thyssanolepis,* var. *thyssanolepis, Polypodium thyssanolepsi, Polypodium tobagense, Polypodium trichophyllum, Polypodium tridactylum, Polypodium tridentatum, Polypodium trifurcaturn* var. *brevipes, Polypodium triglossum, Polypodium truncatulum, Polypodium truncicola* var. *major, Polypodium truncicola* var. *minor, Polypodium tuberosum, Polypodium tunguraguae, Polypodium turquinurn, Polypodium turrialbae, Polypodium ursipes, Polypodium vagans, Polypodium valdealaturn, Polypodium versteegii, Polypodium villagranii, Polypodium virginianum* f. *cambroideum, Polypodium virginianurn* f. *peraferens, Polypodium vittarioides, Polypodium vulgare, Polypodium vulgare* L., *Polypodium vulgare* subsp. *oreophilum, Polypodium vulgare* var. *acuminatum, Polypodium vulpinum, Polypodium williamsii, Polypodium wobbense, Polypodium×fallacissimum-guttatum, Polypodium xantholepis, Polypodium xiphopteris, Polypodium yarumalense, Polypodium yungense,* and *Polypodium zosteriforme.*

In some embodiments the nucleic acid molecule encoding the PtIP-50 polypeptide is derived from a fern species in the Order Polypodiales, Family Polypodiaceae, Genus *Platycerium*. In some embodiments the nucleic acid molecule encoding the PtIP-50 polypeptide is derived from a fern species in the Order Polypodiales, Family Polypodiaceae, Genus *Platycerium* selected from but not limited to *Platycerium alcicorne, Platycerium andinum, Platycerium angolense, Platycerium bifurcatum, Platycerium coronarium, Platycerium elephantotis, Platycerium ellisfi, Platycerium grande, Platycerium hillii, Platycerium holttumfi, Platycerium madagascariense, Platycerium quadridichotomum, Platycerium ridleyi, Platycerium* sp. ES-2011, *Platycerium stemaria, Platycerium superbum, Platycerium veitchii, Platycerium wallichii, Platycerium wandae, Platycerium wilhelminae-reginae*, and *Platycerium willinckii.*

In some embodiments the nucleic acid molecule encoding the PtIP-50 polypeptide is derived from a species in the Division Lycophyta. The phylogeny of extant Lycopods as used herein is based on the classification by N. Wikstrom, *American Fern Journal,* 91:150-156 (2001). Other phylogenic classifications of extant Lycopods are known to one skilled in the art. Additional information on the phylogeny of ferns can be found at mobot.org/MOBOT/research/APweb/(which can be accessed using the "www" prefix) and Schuettpelz E. and Pryer K. M., *TAXON* 56: 1037-1050 (2007) based on three plastid genes. Additional Lycopod species can be found at homepages.caverock.net.nz/~byfern/list.htm (which can be accessed using the http:// prefix).

In some embodiments the nucleic acid molecule encoding the PtIP-50 polypeptide is derived from a species in the Class Isoetopsida or Class Lycopodiopsida.

In some embodiments the nucleic acid molecule encoding the PtIP-50 polypeptide is derived from a species in the Class Isoetopsida Order Selaginales. In some embodiments the nucleic acid molecule encoding the PtIP-50 polypeptide is derived from a fern species in the Class Isoetopsida, Order Selaginales, Family Selaginellaceee. In some embodiments the nucleic acid molecule encoding the PtIP-50 polypeptide is derived from a species in the Genus *Selaginella*. In some embodiments the nucleic acid molecule encoding the PtIP-50 polypeptide is derived from a *Selaginella* species selected from but not limited to *Selaginella acanthonota, Selaginella apoda, Selaginella arbuscula, Selaginella arenicola, Selaginella arizonica, Selaginella armata, Selaginella asprella, Selaginella biformis, Selaginella bigelovii, Selaginella braunii, Selaginella cinerascens, Selaginella cordifolia, Selaginella deflexa, Selaginella delicatula, Selaginella* densa, Selaginella douglasii, Selaginella eatonii, Selaginella eclipes, Selaginella eremophila, Selaginella erythropus, Selaginella flabellata, Selaginella hansenii, Selaginella heterodonta, Selaginella kraussiana, Selaginella krugii, Selaginella laxifolia, Selaginella lepidophylla, Selaginella leucobryoides, Selaginella ludoviciana, Selaginella mutica, Selaginella oregana, Selaginella ovifolia, Selaginella pallescens, Selaginella peruviana, Selaginella pilifera, Selaginella plane, Selaginella plumose, Selaginella pulcherrima, Selaginella rupestris, Selaginella rupincola, Selaginella scopulorum, Selaginella selaginoides, Selaginella sibirica, Selaginella standleyi, Selaginella stellate, Selaginella subcaulescens, Selaginella substipitata, Selaginella tenella, Selaginella tortipila, Selaginella uliginosa, Selaginella umbrosa, Selaginella uncinata, Selaginella underwoodii, Selaginella utahensis, Selaginella victoriae, Selaginella viridissima, Selaginella wallacei, Selaginella watsonii, Selaginella weatherbiana, Selaginella willdenowii, Selaginella wrightii and Selaginella×neomexicana.

In some embodiments the nucleic acid molecule encoding the PtIP-50 polypeptide is derived from a species in the Class Lycopodiopsida, Order Lycopodiales. In some embodiments the nucleic acid molecule encoding the PtIP-50 polypeptide is derived from a fern species in the Class Lycopodiopsida, Order Lycopodiales Family Lycopodiaceae or Family Huperziaceae. In some embodiments the nucleic acid molecule encoding the PtIP-50 polypeptide is derived from a species in the Genus *Austrolycopodium, Dendrolycopodium, Diphasiastrum, Diphasium, Huperzia, Lateristachys, Lycopodiastrum, Lycopodiella, Lycopodium, Palhinhaea, Pseudodiphasium, Pseudolycopodiella, Pseudolycopodium* or *Spinulum*. In some embodiments the nucleic acid molecule encoding the PtIP-50 polypeptide is derived from a species in the Genus *Lycopodium*. In some embodiments the nucleic acid molecule encoding the PtIP-50 polypeptide is derived from a *Lycopodium* species selected from but not limited to *Lycopodium alpinum* L., *Lycopodium annotinum* L., *Lycopodium clavatum* L., *Lycopodium cornplanatum* L., *Lycopodium dendroideum* Michx., *Lycopodium digitatum, Lycopodium xhabereri, Lycopodium hickeyi, Lycopodium×issleri, Lycopodium lagopus, Lycopodium obscurum* L., *Lycopodium phlegmaria* L., *Lycopodium sabinifolium, Lycopodium sitchense, Lycopodium tristachyum, Lycopodium venustulum, Lycopodium venustulum* var. *venustulum, Lycopodium venustulum* var. *verticale, Lycopodium volubile* and *Lycopodium×zeilleri*.

In some embodiments the nucleic acid molecule encoding the PtIP-50 polypeptide is derived from a species in the Genus *Huperzia*. In some embodiments the nucleic acid molecule encoding the PtIP-50 polypeptide is derived from a species selected from but not limited to *Huperzia appressa, Huperzia arctica, Huperzia attenuata, Huperzia australiana, Huperzia balansae, Huperzia billardierei, Huperzia brassii, Huperzia campiana, Huperzia capellae, Huperzia carinata, Huperzia* cf. *carinata* ARF000603, *Huperzia* cf. *nummulariifolia* ARF001140, *Huperzia* cf. *phlegmaria* ARF000717, *Huperzia* cf. *phlegmaria* ARF000771, *Huperzia* cf. *phlegmaria* ARF000785, *Huperzia* cf. *phlegmaria* ARF001007, *Huperzia* cf. *phlegmaria* ARF002568, *Huperzia* cf. *phlegmaria* ARF002703, *Huperzia* cf. *phlegmaria Wikstrom* 1998, *Huperzia chinensis, Huperzia compacta, Huperzia crassa, Huperzia crispata, Huperzia ctyptomeriana, Huperzia cumingii, Huperzia dacrydioides, Huperzia dalhousieana, Huperzia dichotoma, Huperzia emeiensis, Huperzia ericifolia, Huperzia eversa, Huperzia fargesii, Huperzia fordii, Huperzia funiformis, Huperzia goebellii, Huperzia haleakalae, Huperzia hamiltonii, Huperzia heteroclita, Huperzia hippuridea, Huperzia hippuris, Huperzia holstii, Huperzia horizontalis, Huperzia hunanensis, Huperzia hystrix, Huperzia lindenii, Huperzia linifolia, Huperzia lockyeri, Huperzia lucidula, Huperzia mingcheensis, Huperzia miyoshiana, Huperzia nanchuanensis, Huperzia nummulariifolia, Huperzia obtusifolia, Huperzia ophioglossoides, Huperzia petiolate, Huperzia phlegmaria, Huperzia phlegmarioides, Huperzia phyllantha, Huperzia pinifolia, Huperzia polydactyla, Huperzia prolifera, Huperzia reflexa, Huperzia rosenstockiana, Huperzia rufescens, Huperzia salvinoides, Huperzia sarmentosa, Huperzia selago, Huperzia serrata, Huperzia sieboldii, Huperzia somae, Huperzia squarrosa, Huperzia subulata, Huperzia sutchueniana, Huperzia tauri, Huperzia taxifolia, Huperzia tenuis, Huperzia tetragona, Huperzia tetrasticha, Huperzia unguiculata, Huperzia varia, Huperzia verticillata* and *Huperzia wilsonii*.

In some embodiments the nucleic acid molecule encodes a PtIP-50 polypeptide comprising at least one amino acid sequence motif selected from: an amino acid sequence motif 1 as represented by an amino acid sequence of the formula AWK[AT][KS]C[KR]NVA[AV][LV]G[RQ]E[ML][CTS]TTAA[YH]I[SA][EQ]LQY[DEQ]I[QK]VQ[AE]MLQ[EDQ]IA[RQ][KR]QA[DE]RL[SE][SGA]I (SEQ ID NO: 123); an amino acid sequence motif 2 as represented by an amino acid sequence of the formula [EQ][SA]YDQ[ESD][LF][KR]Q[LF][KQ]LF[IV][AQ]QN[KE]ILG[SG]YLL[EQ]QN[RK]AFA[EA][KR]E[RK]DM[ED][VA]FHS (SEQ ID NO: 124); an amino acid sequence motif 3 as represented by an amino acid sequence of the formula F[HR]DRN[EK][TASGERDN]E[VP]L[HE]YEA[AG][TV][PG]L[DV]Y[HQ]YAY[NR]LDTG[EA]TT[LV][TS]NLPS (SEQ ID NO: 125); an amino acid sequence motif 4 as represented by an amino acid sequence of the formula ADL[ST][SN][YF]TE[ML][VA][TS][QE]MDMRTTR[LM]L[LV][EA]LIKVL[HNY][IM]QN[AGV]ALM Y[QE]YLS[EP][PA] SEQ ID NO: 126); an amino acid sequence motif 5 as represented by an amino acid sequence of the formula PFT[RNT]WRLR[LV]SASA[EQ]EN[EKQ]GLAFP (SEQ ID NO: 127); an amino acid sequence motif 6 as represented by an amino acid sequence of the formula DW[LD]IF[VE]NE[VI]E[AG]VA[EA]QMP[TE]EVSE (SEQ ID NO: 128); an amino acid sequence motif 7 as represented by an amino acid sequence of the formula V[TN]M[EDQ]TVW[GR][ML]L[VI]Q[HQ]E[HQ]AA[IV][LQ]GL[LM][RQ]LG[PA][SAP][FS]D[FI][T RV]RT[YF]VVKDIPV[DS]LLL[DH]G (SEQ ID NO: 129); an amino acid sequence motif 8 as represented by an amino acid sequence of the formula IRLD[QK]MEF-SEVM[VA][IV]HRM[FH][IVF][RK][LM][DP][DE]LD[IVL][AG][HL] (SEQ ID NO: 130); an amino acid sequence motif 9 as represented by an amino acid sequence of the formula [AL]A[RE][GK]L[QKE][RK]V[LV][EQ]IL[ED][GD]LQA[VA]MEVV[AK][AI]I[KN][DE]LVESLQE[LI V]GQLV[DE]AP[ED]MP[DE][ML]P[TS]E (SEQ ID NO: 131); an amino acid sequence motif 10 as represented by an amino acid sequence of the formula [TV]FP[LS][TS][WL]SRVRI[HR][HY][LV]EMKF[VD][GQA][AG]A (SEQ ID NO: 132); an amino acid sequence motif 11 as represented by an amino acid sequence of the formula [RK]Q[VL]A[RN]A[LV]FAV[LF][GR]AI[AG][AS][VI][AG]L[AT][FVL][ALV]TGGA (SEQ ID NO: 133); an amino acid sequence motif 12 as represented by an amino acid sequence of the formula [QL][RK][QRT][STI]EL[DQ]N[TA][IML][QE][KR][MI]DQLSLQMET[QE]S[AE][DA]M[ED]QA[KQ R][AE]DM[ED][AE] (SEQ ID NO: 134); an amino acid sequence motif 13 as represented by an amino acid sequence of the formula LVVP[QR]LQY[DH]MYSNLI[N-D][RQ][ML][AV][QR]VA (SEQ ID NO: 135); an amino acid sequence motif 14 as represented by an amino acid sequence of the formula [PA][DV]A[LV]LTDP[NS][IV][LI][LS][GC]MQT[ST][ML]LIAELV[EL][FV][AS][HQ][PN]SS (SEQ ID NO: 136); an amino acid sequence motif 15 as represented by an amino acid sequence of the formula [AT][TV][SG]A[DG][AD]TTQIAITF[HYF][VI][ST]AIR[RQE]I (SEQ ID NO: 137); an amino acid sequence motif 16 as represented by an amino acid sequence of the formula LEGA[ED]KVKRLYVFADVVEL[PE][SG]K (SEQ ID NO: 138); an amino acid sequence motif 17 as represented by an amino acid sequence of the formula P[IV]TD[TS]GE[VI]Y[IM]LLQ[SG]SR (SEQ ID NO: 139); an amino acid sequence motif 18 as represented by an amino acid sequence of the formula T[VL][RS]LPG[ST][IV][MS]VVILCR[VI]L[HV][LV]N[GS] (SEQ ID NO: 140); an amino acid sequence motif 19 as represented by an amino acid sequence of the formula [AV]V[TR][KR]H[VA]EWLN[KT]LL[LV]Q[AV]SAAAQ[GS] (SEQ ID NO: 141); an amino acid sequence motif 20 as represented by an amino acid sequence of the formula [YV][LV]ALL[FY]R[AT]Q[YA][LVF][IL]K[LGM]V[GK] (SEQ ID NO: 142); an amino acid sequence motif 21 as represented by an amino acid sequence of the formula AP[GAL]A[VIM][AS]AA[KGR][GA]AV[ST][AI]AG (SEQ ID NO: 143); an amino acid sequence motif 22 as represented by an amino acid sequence of the formula [ED]D[WY][EQ]FE[IL]PVEDF (SEQ ID NO: 144); an amino acid sequence motif 23 as represented by an amino acid sequence of the formula YS[EH]LYR[DE][LV]NQ[VI]S (SEQ ID NO: 145); and an amino acid sequence motif 24 as represented by an amino acid sequence of the formula F[AI][NR]TFMRMT (SEQ ID NO: 146).

In some embodiments the nucleic acid molecule encodes a PtIP-50 polypeptide comprising at least one amino acid sequence motif selected from: an amino acid sequence motif 1 having at least 90% identity to an amino acid sequence of AWK[AT][KS]C[KR] NVA[AV][LV]G[RQ] E[ML][CTS]TTAA[YH]I[SA][EQ] LQY[DEQ]I[QK]VQ[AE]MLQ[EDQ]IA[RQ][KR]QA[DE]RL[SE][SGA]I (SEQ ID NO: 123); an amino acid sequence motif 2 having at least 90% identity to an amino acid sequence of [EQ][SA]YDQ[ESD][LF][KR]Q[LF][KQ]LF[IV][AQ]QN[KE]ILG[SG]YLL[EQ]QN[RK]AFA[EA][KR]E[RK]DM[ED][VA]FHS (SEQ ID NO: 124); an amino acid sequence motif 3 having at least 90% identity to an amino acid sequence of F[HR]DRN[EK][TASGERDN]E[VP]L[HE]YEA[AG][TV][PG]L[DV]Y[HQ]YAY[NR]LDTG[EA]TT[LV][TS]NLPS (SEQ ID NO: 125); an amino acid sequence motif 4 having at least 90% identity to an amino acid sequence of ADL[ST][SN][YF]TE[ML][VA][TS][QE]MDMRTTR[LM]L[LV][EA]LIKVL[HNY][IM]QN[AGV]ALM Y[QE]YLS[EP][PA] (SEQ ID NO: 126); an amino acid sequence motif 5 having at least 90% identity to an amino acid sequence of PFT[RNT]WRLR[LV]SASA[EQ]EN[EKQ]GLAFP (SEQ ID NO: 127); an amino acid sequence motif 6 having at least 90% identity to an amino acid sequence of DW[LD]IF[VE]NE[VI]E[AG]VA[EA]QMP[TE]EVSE (SEQ ID NO: 128); an amino acid sequence motif 7 having at least 90% identity to an amino acid sequence of V[TN]M[EDQ]TVW[GR][ML]L[VI]Q[HQ]E[HQ]AA[IV][LQ]GL[LM][RQ]LG[PA][SAP][FS]D[FI][T RV]RT[YF]VVKDIPV[DS]LLL[DH]G (SEQ ID NO: 129); an amino acid sequence motif 8 having at least 90% identity to an amino acid sequence of IRLD[QK]MEFSEVM[VA][IV]HRM[FH][IVF][RK][LM][DP][DE]LD[IVL][AG][HL] (SEQ ID NO: 130); an amino acid sequence motif 9 having at least 90% identity to an amino acid sequence of [AL]A[RE][GK]L[QKE][RK]V[LV][EQ]IL[ED][GD]LQA[VA]MEVV[AK][AI]I[KN][DE]LVES-LQE[LI V]GQLV[DE]AP[ED]MP[DE][ML]P[TS]E (SEQ ID NO: 131); an amino acid sequence motif 10 having at least 90% identity to an amino acid sequence of [TV]FP[LS][TS][WL]SRVRI[HR][HY][LV]EMKF[VD][GQA][AG]A (SEQ ID NO: 132); an amino acid sequence motif 11 having at least 90% identity to an amino acid sequence of [RK]Q[VL]A[RN]A[LV]FAV[LF][GR]AI[AG][AS][VI][AG]L[AT][FVL][ALV]TGGA (SEQ ID NO: 133); an amino acid sequence motif 12 having at least 90% identity to an amino acid sequence of [QL][RK][QRT][STI]EL[DQ]N[TA][IML][QE][KR][MI]DQLSLQMET[QE]S[AE][DA]M[ED]QA[KQ R][AE]DM[ED][AE] (SEQ ID NO: 134); an amino acid sequence motif 13 having at least 90% identity to an amino acid sequence of LVVP[QR]LQY[DH]MYSN-LI[ND][RQ][ML][AV][QR]VA (SEQ ID NO: 135); an amino acid sequence motif 14 having at least 90% identity to an amino acid sequence of [PA][DV]A[LV]LTDP[NS][IV][LI][LS][GC]MQT[ST][ML]LIAELV[EL][FV][AS][HQ][PN]SS (SEQ ID NO: 136); an amino acid sequence motif 15 having at least 90% identity to an amino acid sequence of [AT][TV][SG]A[DG][AD]TTQIAITF[HYF][VI][ST]AIR[RQE]I (SEQ ID NO: 137); an amino acid sequence motif 16 having at least 90% identity to an amino acid sequence of LEGA[ED]KVKRLYVFADVVEL[PE][SG]K (SEQ ID NO: 138); an amino acid sequence motif 17 having at least 90% identity to an amino acid sequence of P[IV]TD[TS]GE[VI]Y[IM]LLQ[SG]SR (SEQ ID NO: 139); an amino acid sequence motif 18 having at least 90% identity to an amino acid sequence of T[VL][RS]LPG[ST][IV][MS]VVILCR[VI]L[HV][LV]N[GS] (SEQ ID NO: 140); an amino acid sequence motif 19 having at least 90% identity to an amino acid sequence of [AV]V[TR][KR]H[VA]EWLN[KT]LL[LV]Q[AV]SAAAQ[GS] (SEQ ID NO: 141); an amino acid sequence motif 20 having at least 90% identity to an amino acid sequence of [YV][LV]ALL[FY]R[AT]Q[YA][LVF][IL]K[LGM]V[GK] (SEQ ID NO: 142); an amino acid sequence motif 21 having at least 90% identity to an amino acid sequence of AP[GAL]A[VIM][AS]AA[KGR][GA]AV[ST][AI]AG (SEQ ID NO: 143); an amino acid sequence motif 22 having at least 90% identity to an amino acid sequence of [ED]D[WY][EQ]FE[IL]PVEDF (SEQ ID NO: 144); an amino acid sequence motif 23 having at least 90% identity to an amino acid sequence of YS[EH]LYR[DE][LV]NQ[VI]S (SEQ ID NO: 145); an amino acid sequence motif 24 having at least 90% identity to an amino acid sequence of F[AI][NR]TFMRMT (SEQ ID NO: 146).

In some embodiments the nucleic acid molecule encodes a PtIP-50 polypeptide comprising at least one amino acid sequence motif selected from: an amino acid sequence motif 1 as represented by an amino acid sequence of the formula AWK[ATS][KSRT]C[KR]NVA[AVLI][LVI]G[RQKN]E[MLIV][CTS]TTAA[YHWF]I[SAT][EQDN]L QY[DEQN]I[QKNR]VQ[AED]MLQ[EDQN]IA[RQKN][KR]QA[DE]RL[SETD][SGAT]I (SEQ ID NO: 99); an amino acid sequence motif 2 as represented by an amino acid sequence of the formula [EQND][SAT]YDQ[ESDT][LFIV][KR]Q[LFIV][KQRN]LF[IVL][AQN]QN[KERD]ILG[SGT] YLL[E QDN]QN[RK]AFA[EAD][KR]E[RK]DM[ED][VAIL]FHS (SEQ ID NO: 100); an amino acid sequence motif 3 as represented by an amino acid sequence of the formula F[HRK]DRN[EKDR]XTASGERDNE[VPIL]L[HERKD]YEA[AG][TVSIL][PG]L[DVELI]Y[HQN]YAY[NRQK]LDTG[EAD]TT[LVI][TS]NLPS (SEQ ID NO: 101); an amino acid sequence motif 4 as represented by an amino acid sequence of the formula ADL[ST][SNTQ][YF-W]TE[MLIV][VAIL][TS][QEDN]MDMRTTR[LMIV]L

[LVI][EAD]LIKVL[HNYW F][IMVL]QN[AGVIL]ALMY [QEDN]YLS[EPD][PA] SEQ ID NO: 102); an amino acid sequence motif 5 as represented by an amino acid sequence of the formula PFT[RNTKQS]WRLR[LVI]SASA[EQDN] EN[EKQDRN]GLAFP (SEQ ID NO: 103); an amino acid sequence motif 6 as represented by an amino acid sequence of the formula DW[LDIVE]IF[VEILD]NE[VIL]E[AG]VA [EAD]QMP[TESD]EVSE (SEQ ID NO: 104); an amino acid sequence motif 7 as represented by an amino acid sequence of the formula V[TNSQ]M[EDQN]TVW[GRK] [MLIV]L[VIL]Q[HQN]E[HQN]AA[IVL][LQIVN]GL [LMIV][RQKN]L G[PA][SAPT][FSWYT]D[FILV] [TRVSKIL]RT[YFW]VVKDIPV[DSET]LLL[DHE]G (SEQ ID NO: 105); an amino acid sequence motif 8 as represented by an amino acid sequence of the formula IRLD[QKNR]MEFSEVM[VAIL][IVL]HRM[FHYW] [IVFL][RK][LMIV][DPE][DE]LD[IVL][AG][HLIV] (SEQ ID NO: 106); an amino acid sequence motif 9 as represented by an amino acid sequence of the formula [ALIV]A[REKD] [GKR]L[QKENRD][RK]V[LVI][EQDN]IL[ED][GDE] LQA[VAIL]MEVV[AKR][AILV]I[KNRQ][DE]LVESLQE [LIV]GQLV[DE]AP[ED]MP[DE][MLIV]P[TS]E (SEQ ID NO: 107); an amino acid sequence motif 10 as represented by an amino acid sequence of the formula [TVSIL][FP [LSIVT][TS][WLYFVI]SRVRI[HRK][HYWF][LVI] EMKF[VDILE][GQAN][AG]A (SEQ ID NO: 108); an amino acid sequence motif 11 as represented by an amino acid sequence of the formula [RK]Q[VLI]A[RN]A[LVI] FAV[LFIV][GRK]AI[AG][AST][VIL][AG]L[ATS][FVLI] [ALVI]TGGA (SEQ ID NO: 109); an amino acid sequence motif 12 as represented by an amino acid sequence of the formula [QLNIV][RK][QRTNKS][STILV]EL[DQEN]N [TAS][IMLV][QEDN][KR][MIVL]DQLSLQMET[QED N]S[AED][DAE]M[ED]QA[KQRN][AED]DM[ED][AED] (SEQ ID NO: 110); an amino acid sequence motif 13 as represented by an amino acid sequence of the formula LWP[QRNK]LQY[DHE]MYSNLI[NDQE][RQKN] [MLIV][AVIL][QRNK]VA (SEQ ID NO: 111); an amino acid sequence motif 14 as represented by an amino acid sequence of the formula [PA][DVELI]A[LVI]LTDP[NSQT] [IVL][LIV][LSIVT][GC]MQT[ST][MLIV]LIAELV[EL-DIV][FVIL][A ST][HQN][PNQ]SS (SEQ ID NO: 112); an amino acid sequence motif 15 as represented by an amino acid sequence of the formula [ATS][TVSIL][SGT]A[DGE] [ADE]TTQIAITF[HYFW][VIL][ST]AIR[RQEKND]I (SEQ ID NO: 113); an amino acid sequence motif 16 as represented by an amino acid sequence of the formula LEGA[ED]KVKRLYVFADVVEL[PED][SGT]K (SEQ ID NO: 114); an amino acid sequence motif 17 as represented by an amino acid sequence of the formula P[IVL]TD[TS] GE[VIL]Y[IMVL]LLQ[SGT]SR (SEQ ID NO: 115); an amino acid sequence motif 18 as represented by an amino acid sequence of the formula T[VLI][RSKT]LPG[ST][IVL] [MST]WILCR[VIL]L[HVIL][LVI]N[GST] (SEQ ID NO: 116); an amino acid sequence motif 19 as represented by an amino acid sequence of the formula [AVIL]V[TR][KR]H [VAIL]EWLN[KT]LL[LVI]Q[AVIL]SAAAQ[GST] (SEQ ID NO: 117); an amino acid sequence motif 20 as represented by an amino acid sequence of the formula [YV][LVI] ALL[FYW]R[ATS]Q[YAWF][LVFI][ILV]K[LGMIV]V [GKR] (SEQ ID NO: 118); and an amino acid sequence motif 21 as represented by an amino acid sequence of the formula AP[GALIV]A[VIML][AST]AA[KGR][GA]AV[S-T][AIL]AG (SEQ ID NO: 119); an amino acid sequence motif 22 as represented by an amino acid sequence of the formula [ED]D[WYF][EQDN]FE[ILV]PVEDF (SEQ ID NO: 120); an amino acid sequence motif 23 as represented by an amino acid sequence of the formula YS[EHD]LYR [DE][LVI]NQ[VIL]S (SEQ ID NO: 121) an amino acid sequence motif 24 as represented by an amino acid sequence of the formula F[AIV][NRQK]TFMRMT (SEQ ID NO: 122).

In some embodiments the nucleic acid molecule encodes a PtIP-50 polypeptide comprising at least one amino acid sequence motif selected from: an amino acid sequence motif 1 having at least 90% identity to an amino acid sequence of AWK[ATS][KS]C[KR]NVA[AVIL][LVI]G[RQKN]E [MLIV][CTS]TTAA[YHWF]I[SAT][EQDN]LQY[DEQN]I [QKNR]VQ[AED]MLQ[EDQN]IA[RQKN][KR]QA[DE] RL[SETD][SGAT]I (SEQ ID NO: 99); an amino acid sequence motif 2 having at least 90% identity to an amino acid sequence of [EQDN][SAT]YDQ[ESDT][LFIV][KR]Q [LFIV][KQRN]LF[IVL][AQN]QN[KERD]ILG[SGT] YLL[E QDN]QN[RK]AFA[EAD][KR]E[RK]DM[ED] [VAIL]FHS (SEQ ID NO: 100); an amino acid sequence motif 3 having at least 90% identity to an amino acid sequence of F[HRK]DRN[EKDR][TASGERDNKQ]E [VPIL]L[HERKD]YEA[AG][TVSIL][PG]L[DVELI]Y [HQN]YAY[NRQK]LDTG[EAD]TT[LVI][TS]NLPS (SEQ ID NO: 101); an amino acid sequence motif 4 having at least 90% identity to an amino acid sequence of ADL[ST][SNTQ] [YFW]TE[MLIV][VAIL][TS][QEDN]MDMRTTR[LMIV] L[LVI][EAD]LIKVL[HNYW F][IMVL]QN[AGVIL] ALMY[QEDN]YLS[EPD][PA] (SEQ ID NO: 102); an amino acid sequence motif 5 having at least 90% identity to an amino acid sequence of PFT[RNTKQS]WRLR[LVI] SASA[EQDN]EN[EKQDRN]GLAFP (SEQ ID NO: 103); an amino acid sequence motif 6 having at least 90% identity to an amino acid sequence of DW[LDIVE]IF[VEILD]NE [VIL]E[AG]VA[EAD]QMP[TESD]EVSE (SEQ ID NO: 104); an amino acid sequence motif 7 having at least 90% identity to an amino acid sequence of V[TNSQ]M[EDQN] TVW[GRK][MLIV]L[VIL]Q[HQN]E[HQN]AA[IVL] [LQIVN]GL[LMIV][RQKN]L G[PA][SAPT][FSWYT]D [FILV][TRVSKIL]RT[YFW]VVKDIPV[DSET]LLL [DHE]G (SEQ ID NO: 105); an amino acid sequence motif 8 having at least 90% identity to an amino acid sequence of IRLD[QKNR]MEFSEVM[VAIL][IVL]HRM[FHYW] [IVFL][RK][LMIV][DPE][DE]LD[IVL][AG][HLIV] (SEQ ID NO: 106); an amino acid sequence motif 9 having at least 90% identity to an amino acid sequence of [ALIV]A [REKD][GKR]L[QKENRD][RK]V[LVI][EQDN]IL[ED] [GDE]LQA[VAIL]MEVV[AKR][AILV]I[KNRQ][DE] LVESLQE[LIV]GQLV[DE]AP[ED]MP[DE][MLIV]P [TS]E (SEQ ID NO: 107); an amino acid sequence motif 10 having at least 90% identity to an amino acid sequence of [TVSIL][FP[LSIVT][TS][WLYFVI]SRVRI[HRK][HYWF] [LVI]EMKF[VDILE][GQAN][AG]A (SEQ ID NO: 108); an amino acid sequence motif 11 having at least 90% identity to an amino acid sequence of [RK]Q[VLI]A[RN] A[LVI]FAV[LFIV][GRK]AI[AG][AST][VIL][AG]L[ATS] [FVLI][ALVI]TGGA (SEQ ID NO: 109); an amino acid sequence motif 12 having at least 90% identity to an amino acid sequence of [QLNIV][RK][QRTNKS][STILV]EL [DQEN]N[TAS][IMLV][QEDN][KR][MIVL] DQLSLQMET[QED N]S[AED][DAE]M[ED]QA[KQRN] [AED]DM[ED][AED] (SEQ ID NO: 110); an amino acid sequence motif 13 having at least 90% identity to an amino acid sequence of LWP[QRNK]LQY[DHE]MYSNLI [NDQE][RQKN][MLIV][AVIL][QRNK]VA (SEQ ID NO: 111); an amino acid sequence motif 14 having at least 90% identity to an amino acid sequence of [PA][DVELI]A[LVI] LTDP[NSQT][IVL][LIV][LSIVT][GC]MQT[ST][MLIV] LIAELV[ELDIV][FVIL][A ST][HQN][PNQ]SS (SEQ ID NO: 112); an amino acid sequence motif 15 having at least 90% identity to an amino acid sequence of [ATS][TVSIL] [SGT]A[DGE][ADE]TTQIAITF[HYFW][VIL][ST]AIR [RQEKND]I (SEQ ID NO: 113); an amino acid sequence motif 16 having at least 90% identity to an amino acid sequence of LEGA[ED]KVKRLYVFADVVEL[PED] [SGT]K (SEQ ID NO: 114); an amino acid sequence motif 17 having at least 90% identity to an amino acid sequence of P[IVL]TD[TS]GE[VIL]Y[IMVL]LLQ[SGT]SR (SEQ ID NO: 115); an amino acid sequence motif 18 having at least 90% identity to an amino acid sequence of T[VLI] [RSKT]LPG[ST][IVL][MST]WILCR[VIL]L[HVIL][LVI] N[GST] (SEQ ID NO: 116); an amino acid sequence motif 19 having at least 90% identity to an amino acid sequence of [AVIL]V[TR][KR]H[VAIL]EWLN[KT]LL[LVI]Q [AVIL]SAAAQ[GST] (SEQ ID NO: 117); an amino acid sequence motif 20 having at least 90% identity to an amino acid sequence of [YV][LVI]ALL[FYW]R[ATS]Q[YAWF] [LVFI][ILV]K[LGMIV]V[GKR] (SEQ ID NO: 118); and an amino acid sequence motif 21 having at least 90% identity to an amino acid sequence of AP[GALIV]A[VIML][AST] AA[KGR][GA]AV[ST][AIL]AG (SEQ ID NO: 119); an amino acid sequence motif 22 having at least 90% identity to an amino acid sequence of [ED]D[WYF][EQDN]FE [ILV]PVEDF (SEQ ID NO: 120); an amino acid sequence motif 23 having at least 90% identity to an amino acid sequence of YS[EHD]LYR[DE][LVI]NQ[VIL]S (SEQ ID NO: 121), and an amino acid sequence motif 24 having at least 90% identity to an amino acid sequence of F[AIV] [NRQK]TFMRMT (SEQ ID NO: 122).

In some embodiments the nucleic acid molecule encodes a PtIP-50 polypeptide comprising, sequentially from the N-terminus to the C-terminus, at least one amino acid sequence motif selected from: motif 23; motif 8; motif 16; motif 18; motif 14; motif 19; motif 20; motif 13; motif 2; motif 12; motif 11; motif 21; motif 9; motif 6; motif 1; motif 4; motif 7; motif 22; motif 10; motif 17; motif 3; motif 24; motif 5; and motif 15.

In some embodiments the nucleic acid molecule encodes a PtIP-50 polypeptide comprising, sequentially from the N-terminus to the C-terminus, the amino acid sequence motifs: motif 23; motif 8; motif 16; motif 18; motif 14; motif 19; motif 20; motif 13; motif 2; motif 12; motif 11; motif 21; motif 9; motif 6; motif 1; motif 4; motif 7; motif 22; motif 10; motif 17; motif 3; motif 24; motif 5; and motif 15.

In some embodiments the nucleic acid molecule encodes a PtIP-50 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising 8 to 10 segments of predominately alpha helical structure; and a Region C of between about 150 to about 180 amino acids in length having a consensus secondary structure comprising 6 to 8 segments of predominately beta strand structure. As used herein "predominantly nonconserved secondary structure" means that the regions of secondary structure don't consistently align within the family of PtIP-50 polypeptides. As used herein "predominately alpha helical structure" means that secondary structure prediction may have one or more gap of between 1 to 6 amino acids of coil and/or beta strand structure intervening in the alpha helix structure. As used herein "predominately beta strand structure" means that secondary structure prediction may have one or more gap of between 1 to 6 amino acids of coil and/or alpha helix structure intervening in the beta strand structure. In some embodiments the secondary structure is generated by the PSIPRED, top ranked secondary structure prediction method (Jones D T. (1999) *J. Mol. Biol.* 292: 195-202).

In some embodiments the nucleic acid molecule encodes a PtIP-50 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments the nucleic acid molecule encodes a PtIP-50 polypeptide comprising sequentially from the N-terminus to the C-terminus: a Region A of between about 200 to about 300 amino acids in length having a predominantly nonconserved secondary structure, wherein the Region A comprises a conserved beta strand 1 (β1a) of between about 4 and about 12 amino acids in length within about amino acid residue 50 to about amino acid residue 130 from the N-terminus of the PtIP-50 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments the nucleic acid molecule encodes a PtIP-50 polypeptide comprising sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length, a coil of between about 3 and about 18 amino acids in length and a beta strand 2 (β1b) of between about 4 and about 32 amino acids in length, within about amino acid residue 50 to about amino acid residue 165 from the N-terminus of the PtIP-50 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments the nucleic acid molecule encodes a PtIP-50 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure sequentially comprising i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 10 and about 17 amino acids in length; vi) a coil-3 of between about 11 and about 17 amino acids in length flanked by alpha helix-3 and alpha helix-4; vii) an alpha helix-4 of between about 24 and about 30 amino acids in length; viii) a coil-4 of between about 4 and about 13 amino acids in length flanked by alpha helix-4 and alpha helix-5; ix) an alpha helix-5 of between about 48 and about 58 amino acids in length; x) a coil-5 of between about 10 and about 15 amino acids in length flanked by alpha helix-5 and alpha helix-6; xi) an alpha helix-6 of between about 13 and about 15 amino acids in length; xii) a coil-6 of between about 3 and about 10 amino acids in length flanked by alpha helix-6 and alpha helix-7; xiii) an alpha helix-7 of between about 49 and about 59 amino acids in length; xiv) a coil-7 of between about 0 and about 9 amino acids in length flanked by alpha helix-7 and alpha helix-8; xv) an alpha helix-8 of between about 29 and about 36 amino acids in length; xvi) a coil-8 of between about 11 and about 16 amino acids in length flanked by alpha helix-8 and alpha helix-9; xvii) an alpha helix-9 of between about 16 and about 22 amino acids in length; xviii) a coil-9 of between about 5 and about 9 amino acids in length flanked by alpha helix-9 and Region C; and a Region C of between about 150 to about 180 amino acids in length having a consensus secondary structure comprising seven segments of predominately beta strand structure.

In some embodiments the nucleic acid molecule encodes a PtIP-50 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure sequentially comprising i) a beta strand-1 (β1) of between about 5 amino acids and about 7 amino acids in length; ii) a coil of between about 12 amino acids and about 17 amino acids in length; iii) a beta strand-2 (β2) of between about 11 amino acids and about 15 amino acids in length; iv) a coil of between about 7 amino acids and about 23 amino acids in length; v) a beta strand-3 (β3) of between about 5 amino acids and about 8 amino acids in length; vi) a coil of between about 13 amino acids and about 23 amino acids in length; vii) a beta strand-4 (β4) of between about 3 amino acids and about 7 amino acids in length; viii) a coil of between about 3 amino acids and about 8 amino acids in length; ix) a beta strand-5 (β5) of between about 4 amino acids and about 10 amino acids in length; x) a coil of between about 24 amino acids and about 28 amino acids in length; xi) a beta strand-6 (β6) of between about 5 amino acids and about 7 amino acids in length; xii) a coil of between about 17 amino acids and about 23 amino acids in length; and xiii) a beta strand-1 (β7) of between about 5 amino acids and about 7 amino acids in length.

In some embodiments the nucleic acid molecule encodes a PtIP-50 polypeptide comprising sequentially from the N-terminus to the C-terminus: a Region A of between about 200 to about 300 amino acids in length having a predominantly nonconserved secondary structure; a Region B of between about 380 to about 465 amino acids in length having a consensus secondary structure sequentially comprising i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 10 and about 17 amino acids in length; vi) a coil-3 of between about 11 and about 17 amino acids in length flanked by alpha helix-3 and alpha helix-4; vii) an alpha helix-4 of between about 24 and about 30 amino acids in length; viii) a coil-4 of between about 4 and about 13 amino acids in length flanked by alpha helix-4 and alpha helix-5; ix) an alpha helix-5 of between about 48 and about 58 amino acids in length; x) a coil-5 of between about 10 and about 15 amino acids in length flanked by alpha helix-5 and alpha helix-6; xi) an alpha helix-6 of between about 13 and about 15 amino acids in length; xii) a coil-6 of between about 3 and about 10 amino acids in length flanked by alpha helix-6 and alpha helix-7; xiii) an alpha helix-7 of between about 49 and about 59 amino acids in length; xiv) a coil-7 of between about 0 and about 9 amino acids in length flanked by alpha helix-7 and alpha helix-8; xv) an alpha helix-8 of between about 29 and about 36 amino acids in length; xvi) a coil-8 of between about 11 and about 16 amino acids in length flanked by alpha helix-8 and alpha helix-9; xvii) an alpha helix-9 of between about 16 and about 22 amino acids in length; xviii) a coil-9 of between about 5 and about 9 amino acids in length flanked by alpha helix-9 and beta strand-1 (β1) of Region C; and a Region C of between about 150 to about 180 amino acids in length having a consensus secondary structure sequentially comprising i) a beta strand-1 (β1) of between about 5 amino acids and about 7 amino acids in length; ii) a coil of between about 12 amino acids and about 17 amino acids in length; iii) a beta strand-2 (β2) of between about 11 amino acids and about 15 amino acids in length; iv) a coil of between about 7 amino acids and about 23 amino acids in length; v) a beta strand-3 (β3) of between about 5 amino acids and about 8 amino acids in length; vi) a coil of between about 13 amino acids and about 23 amino acids in length; vii) a beta strand-4 (β4) of between about 3 amino acids and about 7 amino acids in length; viii) a coil of between about 3 amino acids and about 8 amino acids in length; ix) a beta strand-5 (β5) of between about 4 amino acids and about 10 amino acids in length; x) a coil of between about 24 amino acids and about 28 amino acids in length; xi) a beta strand-6 (β6) of between about 5 amino acids and about 7 amino acids in length; xii) a coil of between about 17 amino acids and about 23 amino acids in length; and xiii) a beta strand-1 (β7) of between about 5 amino acids and about 7 amino acids in length.

In some embodiments the nucleic acid molecule encodes a PtIP-50 polypeptide comprising sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length within about amino acid residue 50 to about amino acid residue 130 from the N-terminus of the PtIP-50 polypeptide; a Region B of between about 380 to about 465 amino acids in length having a consensus secondary structure sequentially comprising i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 10 and about 17 amino acids in length; vi) a coil-3 of between about 11 and about 17 amino acids in length flanked by alpha helix-3 and alpha helix-4; vii) an alpha helix-4 of between about 24 and about 30 amino acids in length; viii) a coil-4 of between about 4 and about 13 amino acids in length flanked by alpha helix-4 and alpha helix-5; ix) an alpha helix-5 of between about 48 and about 58 amino acids in length; x) a coil-5 of between about 10 and about 15 amino acids in length flanked by alpha helix-5 and alpha helix-6; xi) an alpha helix-6 of between about 13 and about 15 amino acids in length; xii)

a coil-6 of between about 3 and about 10 amino acids in length flanked by alpha helix-6 and alpha helix-7; xiii) an alpha helix-7 of between about 49 and about 59 amino acids in length; xiv) a coil-7 of between about 0 and about 9 amino acids in length flanked by alpha helix-7 and alpha helix-8; xv) an alpha helix-8 of between about 29 and about 36 amino acids in length; xvi) a coil-8 of between about 11 and about 16 amino acids in length flanked by alpha helix-8 and alpha helix-9; xvii) an alpha helix-9 of between about 16 and about 22 amino acids in length; xviii) a coil-9 of between about 5 and about 9 amino acids in length flanked by alpha helix-9 and beta strand-1 (β1) of Region C; and a Region C of between about 150 to about 180 amino acids in length having a consensus secondary structure sequentially comprising i) a beta strand-1 (β1) of between about 5 amino acids and about 7 amino acids in length; ii) a coil of between about 12 amino acids and about 17 amino acids in length; iii) a beta strand-2 (β2) of between about 11 amino acids and about 15 amino acids in length; iv) a coil of between about 7 amino acids and about 23 amino acids in length; v) a beta strand-3 (β3) of between about 5 amino acids and about 8 amino acids in length; vi) a coil of between about 13 amino acids and about 23 amino acids in length; vii) a beta strand-4 (β4) of between about 3 amino acids and about 7 amino acids in length; viii) a coil of between about 3 amino acids and about 8 amino acids in length; ix) a beta strand-5 (β5) of between about 4 amino acids and about 10 amino acids in length; x) a coil of between about 24 amino acids and about 28 amino acids in length; xi) a beta strand-6 (β6) of between about 5 amino acids and about 7 amino acids in length; xii) a coil of between about 17 amino acids and about 23 amino acids in length; and xiii) a beta strand-1 (β7) of between about 5 amino acids and about 7 amino acids in length.

Polynucleotides Encoding PtIP-65 Polypeptides

One source of polynucleotides that encode PtIP-65 polypeptides or related proteins is a fern or other primitive plant species which contains a PtIP-65 polynucleotide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20 or SEQ ID NO: 21 encoding a PtIP-65 polypeptide SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 and SEQ ID NO: 42, respectively. The polynucleotides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20 and SEQ ID NO: 21 can be used to express PtIP-65 polypeptides in bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode PtIP-65 polypeptides or related proteins. Such probes can be used to identify homologous or substantially homologous polynucleotides derived from *Pteridophyta* species.

Polynucleotides that encode PtIP-65 polypeptides can also be synthesized de novo from a PtIP-65 polypeptide sequence. The sequence of the polynucleotide gene can be deduced from a PtIP-65 polypeptide sequence through use of the genetic code. Computer programs such as "Back-Translate" (GCG™ Package, Acclerys, Inc. San Diego, Calif.) can be used to convert a peptide sequence to the corresponding nucleotide sequence encoding the peptide. Examples of PtIP-65 polypeptides sequences that can be used to obtain corresponding nucleotide encoding sequences include, but are not limited to, the PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 and SEQ ID NO: 42. Furthermore, synthetic PtIP-65 polynucleotide sequences of the disclosure can be designed so that they will be expressed in plants. U.S. Pat. No. 5,500,365 describes a method for synthesizing plant genes to improve the expression level of the protein encoded by the synthesized gene. This method relates to the modification of the structural gene sequences of the exogenous transgene, to cause them to be more efficiently transcribed, processed, translated and expressed by the plant. Features of genes that are expressed well in plants include elimination of sequences that can cause undesired intron splicing or polyadenylation in the coding region of a gene transcript while retaining substantially the amino acid sequence of the toxic portion of the insecticidal protein. A similar method for obtaining enhanced expression of transgenes in monocotyledonous plants is disclosed in U.S. Pat. No. 5,689,052.

In some embodiments the nucleic acid molecule encoding a PtIP-65 polypeptide is a polynucleotide having the sequence set forth in SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20 and SEQ ID NO: 21, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments the nucleic acid molecule encoding the PtIP-65 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; codon optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions;

deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a cDNA. In some embodiments the non-genomic nucleic acid molecule is a synthetic nucleic acid sequence.

In some embodiments the nucleic acid molecule encoding a PtIP-65 polypeptide is a non-genomic polynucleotide having a nucleotide sequence having at least 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity, to the nucleic acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20 or SEQ ID NO: 21, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 22, SEQ ID NO: 24, SEQ ID NO: 26 or SEQ ID NO: 29, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 25, SEQ ID NO: 27, SEQ ID NO: 30, SEQ ID NO: 31, SEQ ID NO: 34, SEQ ID NO: 35 or SEQ ID NO: 36, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 23, SEQ ID NO: 28, SEQ ID NO: 31, SEQ ID NO: 32 or SEQ ID NO: 33, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 41 or SEQ ID NO: 42, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 38 or SEQ ID NO: 40, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 37, wherein the PtIP-65 polypeptide in combination with a PtIP-50 polypeptide has insecticidal activity.

In some embodiments the nucleic acid molecule encodes a PtIP-65 polypeptide comprising an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of PtIP-65 polypeptide of SEQ ID NO: 39, wherein the PtIP-65 polypeptide in combination with a PtIP-50 polypeptide has insecticidal activity.

In some embodiments the nucleic acid molecule encoding a PtIP-65 polypeptide is derived from a fern species in the Division *Pteridophyta*. The phylogeny of ferns as used herein is based on the classification for extant ferns by A. R. Smith et al, *TAXON,* 55:705-731 (2006). The consensus phylogeny based on the classification by A. R. Smith is shown in FIG. 1. Additional information on the phylogeny of ferns can be found at mobot.org/MOBOT/research/AP-web/(which can be accessed using the "www" prefix) and Schuettpelz E. and Pryer K. M., *TAXON* 56: 1037-1050 (2007) based on three plastid genes. Additional fern and other primitive plant species can be found at homepages-.caverock.net.nz/~byfern/list.htm (which can be accessed using the http:// prefix).

In some embodiments the nucleic acid molecule encoding a PtIP-65 polypeptide is derived from a fern species in the Class Psilotopsida. In some embodiments the nucleic acid molecule encoding a PtIP-65 polypeptide is derived from a fern species in the Class Psilotopsida, Order Psilotales. In some embodiments the nucleic acid molecule encoding a PtIP-65 polypeptide is derived from a fern species in the Class Psilotopsida, Order Ophioglossales. In some embodiments the nucleic acid molecule encoding a PtIP-65 polypeptide is derived from a fern species in the Class Psilotopsida, Order Ophioglossales, Family Psilotaceae. In some embodiments the nucleic acid molecule encoding a PtIP-65 polypeptide is derived from a fern species in the Class Psilotopsida, Order Ophioglossales Family Ophioglossaceae. In some embodiments the nucleic acid molecule encoding a PtIP-65 polypeptide is derived from a fern species in the Genus *Ophioglossum* L., *Botrychium, Botrypus, Helminthostachys, Ophioderma, Cheiroglossa, Sceptridium* or *Mankyua*. In some embodiments the nucleic acid molecule encoding a PtIP-65 polypeptide is derived from a fern species in the *Ophioglossum* L. Genus is selected from but not limited to *Ophioglossum califomicum, Ophioglossum coriaceum, Ophioglossum costatum, Ophioglossum crotalophoroides, Ophioglossum engelmannii, Ophioglossum falcaturn, Ophioglossum gomezianurn, Ophioglossum gramineum, Ophioglossum kawamurae, Ophioglossum lusitanicum, Ophioglossum namegatae, Ophioglossum nudicaule, Ophioglossum palmatum, Ophioglossum parvum, Ophioglossum pedunculosum, Ophioglossum pendulum, Ophioglossum petiolatum, Ophioglossum pusillum, Ophioglossum reticulatum, Ophioglossum richardsiae, Ophioglossum thermale*, and *Ophioglossum vulgatum*.

In some embodiments the nucleic acid molecule encoding a PtIP-65 polypeptide is derived from a species in the Class Polypodiopsida/Pteridopsida. In some embodiments the nucleic acid molecule encoding a PtIP-65 polypeptide is derived from a fern species in the Order Osmundales (royal ferns); Family Osmundaceae. In some embodiments the nucleic acid molecule encoding a PtIP-65 polypeptide is derived from a fern species in the Order Hymenophyllales (filmy ferns and bristle ferns); Family Hymenophyllaceae. In some embodiments the nucleic acid molecule encoding a PtIP-65 polypeptide is derived from a fern species in the Order Gleicheniales; Family Gleicheniaceae, Family Dipteridaceael or Family Matoniaceae. In some embodiments the nucleic acid molecule encoding a PtIP-65 polypeptide is derived from a fern species in the Order Schizaeales; Family Lygodiaceae, Family Anemiaceae or Family Schizaeaceae. In some embodiments the nucleic acid molecule encoding a PtIP-65 polypeptide is derived from a fern species in the Order Salviniales; Family Marsileaceae or Family Salviniaceae. In some embodiments the nucleic acid molecule encoding a PtIP-65 polypeptide is derived from a fern species in the Order Cyatheales; Family Thyrsopteridaceae, Family Loxsomataceae, Family Culcitaceae, Family Plagiogyriaceae, Family Cibotiaceae, Family Cyatheaceae, Family Dicksoniaceae or Family Metaxyaceae.

In some embodiments the nucleic acid molecule encoding a PtIP-65 polypeptide is derived from a fern species in the Order Polypodiales; Family Lindsaeaceae, Family Saccolomataceae, Family Cystodiaceae, Family Dennstaedtiaceae, Family Pteridaceae, Family Aspleniaceae, Family Thelypteridaceae, Family Woodsiaceae, Family Onocleaceae, Family Blechnaceae, Family Dryopteridaceae, Family Lomariopsidaceae, Family Tectariaceae, Family Oleandraceae, Family Davalliaceae or Family Polypodiaceae.

In some embodiments the nucleic acid molecule encoding a PtIP-65 polypeptide is derived from a fern species in the Order Polypodiales, Family Pteridaceae, Genus *Adiantaceae* selected from but not limited to *Adiantum aethiopicum, Adiantum aleuticum, Adiantum bonatianum, Adiantum cajennense, Adiantum capillus-junonis, Adiantum capillus-veneris, Adiantum caudatum, Adiantum chienfi, Adiantum chilense, Adiantum cuneatum, Adiantum cunninghamfi, Adiantum davidii, Adiantum diaphanum, Adiantum edentulum, Adiantum edgeworthfi, Adiantum excisum, Adiantum fengianum, Adiantum fimbriatum, Adiantum flabellulatum, Adiantum formosanum, Adiantum formosum, Adiantum fulvum, Adiantum gravesfi, Adiantum hispidulum, Adiantum induratum, Adiantum jordanfi, Adiantum juxtapositum, Adiantum latifolium, Adiantum leveillei, Adiantum lianxianense, Adiantum malesianum, Adiantum mariesfi, Adiantum monochlamys, Adiantum myriosorum, Adiantum obliquum, Adiantum ogasawarense, Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum venustum, Adiantum viridescens*, and *Adiantum viridimontanum*.

In some embodiments the nucleic acid molecule encoding a PtIP-65 polypeptide is derived from a fern species in the Order Polypodiales, Family Aspleniaceae, Genus *Asplenium* L. In some embodiments the nucleic acid molecule encoding a PtIP-65 polypeptide is derived from a fern species in the Order Polypodiales, Family Aspleniaceae, Genus *Asplenium* L selected from but not limited to *Asplenium* abbreviatum, *Asplenium abrotanoides, Asplenium abscissum* var. *subaequilaterale, Asplenium abscissum, Asplenium achilleifolium, Asplenium acuminatum, Asplenium adiantifrons, Asplenium adiantoides, Asplenium adiantoides* var. *squamulosum, Asplenium adiantum-nigrum* L., *Asplenium adiantum-nigrum* var. *adiantum-nigrum, Asplenium adiantum-nigrum* var. *yuanurn, Asplenium adnatum, Asplenium aethiopicum, Asplenium affine, Asplenium affine* var. *affine, Asplenium affine* var. *gilpinae, Asplenium affine* var. *mettenii, Asplenium affine* var. *pecten, Asplenium africanum, Asplenium afzelii, Asplenium aitchisonii, Asplenium alatulum, Asplenium alaturn, Asplenium alfredii, Asplenium altajense, Asplenium amabile, Asplenium ambohitantelense, Asplenium anceps* var. *proliferum, Asplenium andapense, Asplenium andersonii, Asplenium angustatum, Asplenium angustum, Asplenium anisophyllum, Asplenium annetii, Asplenium antiquum, Asplenium antrophyoides, Asplenium apertura, Asplenium apogamum, Asplenium aquaticum, Asplenium arboreum, Asplenium arcanum, Asplenium arcuaturn, Asplenium argentinum, Asplenium argutum, Asplenium aspidiiforme, Asplenium aspidioides, Asplenium asterolepis, Asplenium auricularium* var. *acutidens, Asplenium auricularium* var. *subintegerrimum, Asplenium auriculatum, Asplenium auriculatum* var. *aequilaterale, Asplenium auritum* fo. *diversifolium, Asplenium auritum* fo. *diversifolium, Asplenium auritum* fo. *nana, Asplenium auritum, Asplenium auritum* var. *auriculatum, Asplenium auritum* var. *auritum, Asplenium auritum* var. *bipinnatifidum, Asplenium auritum* var. *bipinnatisectum, Asplenium auritum* var. *davallioides, Asplenium auritum* var. *macilentum, Asplenium auritum* var. *rigidum, Asplenium auritum* var. *subsimplex, Asplenium austrochinense, Asplenium ayopayense, Asplenium badinii*,

*Asplenium balense, Asplenium ballivianii, Asplenium bangii, Asplenium bangii, Asplenium barbaense, Asplenium barclayanum, Asplenium barkamense, Asplenium barteri, Asplenium basiscopicum, Asplenium bicrenatum, Asplenium bifrons, Asplenium bipartitum, Asplenium blastophorum, Asplenium blepharodes, Asplenium blepharophorum, Asplenium boiteaui, Asplenium bolivianurn, Asplenium boltonii, Asplenium borealichinense, Asplenium bradei, Asplenium bradeorum, Asplenium bradleyi, Asplenium brausei, Asplenium breedlovei, Asplenium buettneri, Asplenium buettneri* var. *hildebrandtii, Asplenium bulbiferum, Asplenium bullatum* var. *bullatum, Asplenium bullatum* var. *shikokianum, Asplenium bullatum, Asplenium cancellatum, Asplenium capillipes, Asplenium cardiophyllum* (Hance), *Asplenium caripense, Asplenium carvalhoanurn, Asplenium castaneoviride, Asplenium castaneum, Asplenium caudatum, Asplenium celtidifolium* (Kunze), *Asplenium ceratolepis, Asplenium changputungense, Asplenium chaseanum, Asplenium cheilosorum, Asplenium chengkouense, Asplenium chihuahuense, Asplenium chimantae, Asplenium chimborazense, Asplenium chingianurn, Asplenium chlorophyllum, Asplenium chondrophyllum, Asplenium cicutarium, Asplenium cicutarium* var. *paleaceum, Asplenium cirrhatum, Asplenium cladolepton, Asplenium claussenii, Asplenium coenobiale, Asplenium commutatum, Asplenium congestum, Asplenium conquisitum, Asplenium consimile, Asplenium contiguum, Asplenium contiguum* var. *hirtulum, Asplenium corderoi, Asplenium cordovense, Asplenium coriaceum, Asplenium coriffolium, Asplenium correardii, Asplenium costale, Asplenium costale* var. *robustum, Asplenium cowanii, Asplenium crenulatoserrulatum, Asplenium crenulatum, Asplenium crinicaule, Asplenium crinulosum, Asplenium cristatum, Asplenium cryptolepis* Fernald, *Asplenium cultrifolium* L., *Asplenium cuneatiforme, Asplenium cuneaturn, Asplenium curvatura, Asplenium cuspidatum, Asplenium cuspidatum* var *cuspidatum, Asplenium cuspidatum* var. *foeniculaceum, Asplenium cuspidatum* var. *triculum, Asplenium cuspidatum* var. *tripinnaturn, Asplenium dalhousiae, Asplenium dareoides, Asplenium davallioides, Asplenium davisii, Asplenium debile, Asplenium debile, Asplenium decussatum, Asplenium delavayi, Asplenium delicatulum, Asplenium delicatulum* var. *cocosensis, Asplenium delitescens, Asplenium delitescens×laetum, Asplenium densum, Asplenium dentatum* L., *Asplenium dentatum* L., *Asplenium depauperaturn, Asplenium deqenense, Asplenium dianae, Asplenium difforme, Asplenium dilataturn, Asplenium dimidiaturn, Asplenium dimidiatum* var. *boliviense, Asplenium diplazisorum, Asplenium dissectum, Asplenium distans, Asplenium divaricatum, Asplenium divergens, Asplenium divisissimum, Asplenium doederleinii, Asplenium donnell-smithii, Asplenium dregeanum, Asplenium dulongjiangense, Asplenium duplicatoserratum, Asplenium eatonii, Asplenium ebeneum, Asplenium ebenoides, Asplenium ecuadorense, Asplenium eggersii, Asplenium emarginatum, Asplenium enaturn, Asplenium ensiforme* fo. *bicuspe, Asplenium ensiforme* fo. *ensiforme, Asplenium ensiforme* fo. *stenophyllum, Asplenium ensiforme, Asplenium erectum* var. *erectum, Asplenium erectum* var. *gracile, Asplenium erectum* var. *usambarense, Asplenium erectum* var. *zeyheri*, &, *Asplenium erosum* L., *Asplenium escaleroense, Asplenium esculentum, Asplenium eutecnum, Asplenium excelsum, Asplenium excisum, Asplenium exiguum, Asplenium extensum, Asplenium falcaturn, Asplenium falcinellum, Asplenium faurei, Asplenium feel, Asplenium fengyangshanense, Asplenium ferulaceum, Asplenium fibrillosum, Asplenium filix-femina, Asplenium finckii, Asplenium finlaysonianurn, Asplenium flabellulatum, Asplenium flabellulatum* var *flabellulatum, Asplenium flabellulatum* var. *partitum, Asplenium flaccidum, Asplenium flavescens, Asplenium flavidum, Asplenium flexuosum, Asplenium fluminense, Asplenium foeniculaceum, Asplenium formosanum, Asplenium formosum* var. *carolinurn, Asplenium formosum* var. *incultum, Asplenium formosum, Asplenium fournieri, Asplenium fragile, Asplenium fragile* var. *lomense, Asplenium fragrans, Asplenium fragrans* var. *foeniculaceum, Asplenium franconis* var. *gracile, Asplenium fraxinifolium, Asplenium friesiorum, Asplenium friesiorum* var. *nesophilum, Asplenium fugax, Asplenium fujianense, Asplenium furcatum, Asplenium furfuraceum, Asplenium fuscipes, Asplenium fuscopubescens, Asplenium galeottii, Asplenium gautieri, Asplenium gemmiferum, Asplenium gentryi, Asplenium geppii, Asplenium ghiesbreghtii, Asplenium gilliesii, Asplenium gilpinae, Asplenium glanduliserraturn, Asplenium glenniei, Asplenium goldmannii, Asplenium gomezianurn, Asplenium grande, Asplenium grandifolium, Asplenium grandifrons, Asplenium gregoriae, Asplenium griffithianum, Asplenium gulingense, Asplenium hainanense, Asplenium hallbergii, Asplenium hallei, Asplenium hallii, Asplenium hangzhouense, Asplenium haplophyllum, Asplenium harpeodes, Asplenium harpeodes* var. *glaucovirens, Asplenium harpeodes* var. *incisura, Asplenium harrisii* Jenman, *Asplenium harrisonii, Asplenium hastatum, Asplenium hebeiense, Asplenium hemionitideum, Asplenium hemitomurn, Asplenium hentyi, Asplenium herpetopteris, Asplenium herpetopteris* var *herpetopteris, Asplenium herpetopteris* var. *acutipinnata, Asplenium herpetopteris* var. *masoulae, Asplenium herpetopteris* var. *villosum, Asplenium hesperium, Asplenium heterochroum, Asplenium hians, Asplenium hians* var. *pallescens, Asplenium hoffmannii, Asplenium holophlebium, Asplenium hondoense, Asplenium horridum, Asplenium hostmannii, Asplenium humistratum, Asplenium hypomelas, Asplenium inaequilaterale, Asplenium incisura, Asplenium incurvaturn, Asplenium indicum, Asplenium indicum* var. *indicum, Asplenium indicum* var. *yoshingagae, Asplenium induratum, Asplenium indusiatum, Asplenium inexpectatum, Asplenium insigne, Asplenium insiticium, Asplenium insolitum, Asplenium integerrimurn, Asplenium interjectum, Asplenium jamesonii, Asplenium jaundeense, Asplenium juglandifolium, Asplenium kangdingense, Asplenium kansuense, Asplenium kassneri, Asplenium kaulfussii, Asplenium kellermanii, Asplenium kentuckiense, Asplenium khullarii, Asplenium kiangsuense, Asplenium kunzeanurn, Asplenium lacerum, Asplenium laciniatum, Asplenium laciniatum* var. *acutipinna, Asplenium laciniatum* var. *laciniatum, Asplenium laetum* fo. *minor, Asplenium laetum, Asplenium laetum* var. *incisoserratum, Asplenium lamprocaulon, Asplenium laserpitiifolium* var. *morrisonense, Asplenium lastii, Asplenium latedens, Asplenium latifolium, Asplenium laui, Asplenium laurentii, Asplenium leandrianurn, Asplenium lechleri, Asplenium leiboense, Asplenium lepidorachis, Asplenium leptochlamys, Asplenium leptophyllum, Asplenium levyi, Asplenium lindbergii, Asplenium lindeni, Asplenium lineatum, Asplenium lividum, Asplenium lobatum, Asplenium lobaturn, Asplenium lokohoense, Asplenium longicauda, Asplenium longicaudaturn, Asplenium longifolium, Asplenium longisorum, Asplenium longjinense, Asplenium lorentzii, Asplenium loriceum, Asplenium loxogrammoides, Asplenium lugubre, Asplenium lunulatum, Asplenium lunulatum* var. *pteropus, Asplenium lushanense, Asplenium lydgatei, Asplenium macilentum, Asplenium macraei, Asplenium macrodictyon, Asplenium macrophlebium, Asplenium macrophyllum, Asplenium macropterum, Asplenium macrosorum, Asplenium macrotis, Asplenium macrurum, Asplenium mainlingense, Asplenium mangindranense, Asp-* lenium mannii, Asplenium marginatum L., Asplenium marojejyense, Asplenium martianum, Asplenium matsumurae, Asplenium mauritiensis Lorence, Asplenium maximum, Asplenium, ii, Asplenium megalura, Asplenium megaphyllum, Asplenium meiotomurn, Asplenium melanopus, Asplenium membranifolium, Asplenium meniscioides, Asplenium mesosorum, Asplenium mexicanurn, Asplenium micropaleatum, Asplenium microtum, Asplenium mildbraedii, Asplenium mildei, Asplenium minimum, Asplenium minutum, Asplenium miradorense, Asplenium miyunense, Asplenium moccenianurn, Asplenium mocquetysii, Asplenium modestum, Asplenium monanthemum var. menziesii, Asplenium monanthes L., Asplenium monanthes var monanthes, Asplenium monanthes var. castaneum, Asplenium monanthes var. wagneri, Asplenium monanthes var. yungense, Asplenium monodon, Asplenium montanum, Asplenium mosetenense, Asplenium moupinense, Asplenium mucronatum, Asplenium munchii, Asplenium muticum, Asplenium myapteron, Asplenium myriophyllum, Asplenium nakanoanum, Asplenium nanchuanense, Asplenium nemorale, Asplenium neolaserpitiifolium, Asplenium neomutijugum, Asplenium neovarians, Asplenium nesii, Asplenium nesioticum, Asplenium nidus L., Asplenium nigricans, Asplenium niponicum, Asplenium normale, Asplenium normale var. angustum, Asplenium obesum, Asplenium oblongatum, Asplenium oblongifolium, Asplenium obovatum, Asplenium obscurum, Asplenium obscurum var. angustum, Asplenium obtusatum var. obtusatum, Asplenium obtusatum var. sphenoides, Asplenium obtusifolium L., Asplenium obtusissimum, Asplenium obversum, Asplenium ochraceum, Asplenium oellgaardii, Asplenium ofeliae, Asplenium oldhami, Asplenium oligosorum, Asplenium olivaceum, Asplenium onopteris L., Asplenium onustum, Asplenium ortegae, Asplenium otites, Asplenium palaciosii, Asplenium palmeri, Asplenium partitum, Asplenium parvisorum, Asplenium parviusculum, Asplenium parvulum, Asplenium patens, Asplenium paucifolium, Asplenium paucijugum, Asplenium paucivenosum, Asplenium pearcei, Asplenium pekinense, Asplenium pellucidum, Asplenium pendulum, Asplenium petiolulatum, Asplenium phyllitidis, Asplenium pimpinellifolium, Asplenium pinnatifidum, Asplenium pinnatum, Asplenium platyneuron, Asplenium platyneuron var. bacculum-rubrum, Asplenium platyneuron var. incisum, Asplenium platyphyllum, Asplenium plumbeum, Asplenium poloense, Asplenium polymeris, Asplenium polymorphum, Asplenium polyodon, Asplenium polyodon var. knudsenii, Asplenium polyodon var. nitidulum, Asplenium polyodon var. sectum, Asplenium polyodon var. subcaudatum, Asplenium polyphyllum, Asplenium poolii, Asplenium poolii fo. simplex, Asplenium poolii var. linearipinnatum, Asplenium potosinum, Asplenium potosinum var. incisum, Asplenium praegracile, Asplenium praemorsum, Asplenium preussii, Asplenium pringleanum, Asplenium pringlei, Asplenium prionitis, Asplenium procerum, Asplenium progrediens, Asplenium projectum, Asplenium prolongatum, Asplenium propinquum, Asplenium protensum, Asplenium pseudoangustum, Asplenium pseudoerectum, Asplenium pseudofontanum, Asplenium pseudolaserpitiifolium, Asplenium pseudonormale, Asplenium pseudo pellucidum, Asplenium pseudopraemorsum, Asplenium pseudovarians, Asplenium pseudowilfordii, Asplenium pseudowrightii, Asplenium psilacrum, Asplenium pteropus, Asplenium pubirhizoma, Asplenium pulchellum, Asplenium pulchellum var. subhorizontale, Asplenium pulcherrimum, Asplenium pulicosum, Asplenium pulicosum var. maius, Asplenium pululahuae, Asplenium pumilum, Asplenium pumilum var. hymenophylloides, Asplenium pumilum var. laciniatum, Asplenium purdieanum, Asplenium purpurascens, Asplenium pyramidatum, Asplenium qiujiangense, Asplenium quercicola, Asplenium quitense, Asplenium raddianum, Asplenium radiatum, Asplenium radicans L., Asplenium radicans, Asplenium radicans var. costaricense, Asplenium radicans var. partitum, Asplenium radicans var. radicans, Asplenium radicans var. uniseriale, Asplenium recumbens, Asplenium reflexum, Asplenium regulare var. latior, Asplenium repandulum, Asplenium repens, Asplenium repente, Asplenium resiliens, Asplenium retusulum, Asplenium rhipidoneuron, Asplenium rhizophorum L., Asplenium rhizophyllum, Asplenium rhizophyllum L., Asplenium rhizophyllum var. proliferum, Asplenium rhomboideum, Asplenium rigidum, Asplenium riparium, Asplenium rivale, Asplenium rockii, Asplenium roemerianum, Asplenium roemerianum var. mindensis, Asplenium rosenstockianum, Asplenium rubinum, Asplenium ruizianum, Asplenium rusbyanum, Asplenium ruta-muraria L., Asplenium ruta-muraria var. cryptolepis, Asplenium rutaceum, Asplenium rutaceum var. disculiferum, Asplenium rutaefolium, Asplenium rutifolium, Asplenium salicifolium L., Asplenium salicifolium var. aequilaterale, Asplenium salicifolium var. salicifolium, Asplenium sampsoni, Asplenium sanchezii, Asplenium sanderi, Asplenium sandersonii, Asplenium sanguinolentum, Asplenium sarelii, Asplenium sarelii var. magnum, Asplenium sarelii var. sarelii, Asplenium saxicola, Asplenium scalifolium, Asplenium scandicinum, Asplenium schizophyllum, Asplenium schkuhrii, Asplenium sciadophilum, Asplenium scolopendrium L., Asplenium scortechinii, Asplenium seileri, Asplenium semipinnatum, Asplenium septentrionale, Asplenium serra, Asplenium serra var. imrayanum, Asplenium serratissimum, Asplenium serratum L., Asplenium serratum var. caudatum, Asplenium serricula, Asplenium sessilifolium, Asplenium sessilifolium var. guatemalense, Asplenium sessilifolium var. minus, Asplenium sessilifolium var. occidentale, Asplenium sessilipinnum, Asplenium setosum, Asplenium shepherdii, Asplenium shepherdii var. bipinnatum, Asplenium shepherdii var. flagelliferum, Asplenium shikokianum, Asplenium simii, Asplenium simonsianum, Asplenium sintenisii, Asplenium skinneri, Asplenium skinneri, Asplenium sodiroi, Asplenium soleirolioides, Asplenium solidum var. stenophyllum, Asplenium solmsii, Asplenium sp.-N.-Halle-2234, Asplenium spathulinum, Asplenium spectabile, Asplenium speluncae, Asplenium sphaerosporum, Asplenium sphenotomum, Asplenium spinescens, Asplenium splendens, Asplenium sprucei, Asplenium squamosum L., Asplenium standleyi, Asplenium stellatum, Asplenium stenocarpum, Asplenium stoloniferum, Asplenium stolonipes, Asplenium striatum L., Asplenium stuebelianum, Asplenium stuhlmannii, Asplenium suave, Asplenium subalatum, Asplenium subcrenatum, Asplenium subdigitatum, Asplenium subdimidiatum, Asplenium subintegrum, Asplenium sublaserpitiifolium, Asplenium sublongum, Asplenium subnudum, Asplenium suborbiculare, Asplenium subtenuifolium, Asplenium subtile, Asplenium subtoramanum, Asplenium subtrapezoideum, Asplenium subvarians, Asplenium sulcatum, Asplenium sylvaticum, Asplenium szechuanense, Asplenium taiwanense, Asplenium tenerrimum, Asplenium tenerum, Asplenium tenuicaule, Asplenium tenuifolium, Asplenium tenuifolium var. minor, Asplenium tenuifolium var. tenuifolium, Asplenium tenuissimum, Asplenium ternatum, Asplenium theciferum, Asplenium theciferum var. concinnum, Asplenium thunbergii, Asplenium tianmushanense, Asplenium tianshanense, Asplenium tibeticum, Asplenium tocoraniense, Asplenium toramanum, Asplenium trapezoideum, Asplenium tricholepis, Asplenium trichomanes L., Asplenium trichomanes subsp. inexpectans, Asplenium trichomanes subsp. quadri-

*valens, Asplenium trichomanes* subsp. *trichomanes, Asplenium trichomanes* var. *harovii, Asplenium trichomanes* var. *herbaceum, Asplenium trichomanes* var. *repens, Asplenium trichomanes* var. *viridissimum, Asplenium trichomanes-dentatum L., Asplenium trigonopterum, Asplenium trilobatum, Asplenium trilobum, Asplenium triphyllum, Asplenium triphyllum* var. *cornpactum, Asplenium triphyllum* var. *gracillimum, Asplenium triphyllum* var. *herbaceum, Asplenium tripteropus, Asplenium triquetrum, Asplenium truncorum, Asplenium tsaratananense, Asplenium tucumanense, Asplenium tuerckheimii, Asplenium tunquiniense, Asplenium ulbrichtii, Asplenium ultimurn, Asplenium unilaterale, Asplenium unilaterale* var. *decurrens, Asplenium unilaterale* var. *udum, Asplenium unilaterale* var. *unilaterale, Asplenium uniseriale, Asplenium uropteron, Asplenium vagans, Asplenium vareschianum, Asplenium variabile* var. *paucijugum, Asplenium variabile* var. *variabile, Asplenium varians* subsp. *fimbriatum, Asplenium varians, Asplenium vastum, Asplenium venturae, Asplenium venulosum, Asplenium verapax, Asplenium vesiculosum, Asplenium vespertinurn, Asplenium villosum, Asplenium virens, Asplenium viride, Asplenium viridifrons, Asplenium virillae, Asplenium viviparioides, Asplenium viviparum, Asplenium viviparum* var *viviparum, Asplenium viviparum* var. *lineatu, Asplenium volubile, Asplenium vulcanicum, Asplenium wacketii, Asplenium wagneri, Asplenium wallichianum, Asplenium warneckei, Asplenium wilfordii, Asplenium williamsii, Asplenium wrightii, Asplenium wrightioides, Asplenium wuliangshanense, Asplenium xianqianense, Asplenium xinjiangense, Asplenium xinyiense, Asplenium yelagagense, Asplenium yoshinagae, Asplenium yunnanense, Asplenium zamiifolium, Asplenium zanzibaricum, Asplenium biscayneanum, Asplenium curtissii, Asplenium ebenoides, Asplenium herb-wagneri, Asplenium heteroresiliens, Asplenium kenzoi, Asplenium plenum, Asplenium wangii,* and *Asplenium×clermontiae, Asplenium×gravesii.*

In some embodiments the nucleic acid molecule encoding a PtIP-65 polypeptide is derived from a fern species in the Order Polypodiales, Family Blechnaceae, Genus *Blechnum* L. In some embodiments the nucleic acid molecule encoding a PtIP-65 polypeptide is derived from a fern species in the Order Polypodiales, Family Blechnaceae, Genus *Blechnum* L. selected from but not limited to *Blechnum amabile, Blechnum appendiculatum, Blechnum articulatum, Blechnum australe, Blechnum austrobrasilianum, Blechnum binervatum, Blechnum blechnoides, Blechnum brasiliense, Blechnum capense, Blechnum cartilagineum, Blechnum castaneum, Blechnum chambersii, Blechnum chilense, Blechnum colensoi, Blechnum contiguum, Blechnum cordatum, Blechnum coriaceum, Blechnum discolor, Blechnum doodioides, Blechnum durum, Blechnum eburneum, Blechnum ensiforme, Blechnum filiforme, Blechnum fluviatile, Blechnum fragile, Blechnum fraseri, Blechnum fullagari, Blechnum gibbum, Blechnum glandulosum, Blechnum gracile, Blechnum hancockii, Blechnum hastatum, Blechnum howeanum, Blechnum indicum, Blechnum kunthianum, Blechnum laevigatum, Blechnum loxense, Blechnum magellanicum, Blechnum membranaceum, Blechnum microbasis, Blechnum microphyllum, Blechnum milnei, Blechnum minus, Blechnum mochaenum, Blechnum montanum, Blechnum moorei, Blechnum moritzianum, Blechnum nigrum, Blechnum niponicum, Blechnum norfolkianum, Blechnum novaezelandiae, Blechnum nudurn, Blechnum obtusatum, Blechnum occidentale, Blechnum oceanicum, Blechnum orientale, Blechnum patersonii, Blechnum penna-marina, Blechnum polypodioides, Blechnum procerum, Blechnum punctulatum, Blechnum sampaioanum, Blechnum schiedeanum, Blechnum schomburgkii, Blechnum serrulatum, Blechnum simillimum, Blechnum spicant, Blechnum stipitellatum, Blechnum tabulare, Blechnum triangularifolium, Blechnum vieillardii, Blechnum vulcanicum, Blechnum wattsii, Blechnum whelanii,* and *Blechnum wurunuran.*

In some embodiments the nucleic acid molecule encoding a PtIP-65 polypeptide is derived from a fern species in the Order Polypodiales, Family Dryopteridaceae Genus *Acrophorus,* Genus *Acrorumohra,* Genus *Anapausia,* Genus *Arachniodes,* Genus *Bolbitis,* Genus *Ctenitis,* Genus *Cyclodium,* Genus *Cyrtogonellum,* Genus *Cyrtomidictyum,* Genus *Cyrtomium,* Genus *Diacalpe,* Genus *Didymochlaena,* Genus *Dryopsis,* Genus *Dryopteris,* Genus *Elaphoglossum,* Genus *Hypodematium,* Genus *Lastreopsis,* Genus *Leptorumohra,* Genus *Leucostegia,* Genus *Lithostegia,* Genus *Lomagramma,* Genus *Maxonia,* Genus *Megalastrum,* Genus *Olfersia,* Genus *Peranema,* Genus *Phanerophlebia,* Genus *Phanerophlebiopsis,* Genus *Polybotrya,* Genus *Polystichopsis,* Genus *Polystichum,* Genus *Rumohra,* Genus *Sorolepidium,* Genus *Stigmatopteris* or Genus *Teratophyllum.* In some embodiments the nucleic acid molecule encoding a PtIP-65 polypeptide is derived from a fern species in the Order Polypodiales, Family Dryopteridaceae, Genus *Bolbitis,* selected from but not limited to *Bolbitis acrostichoides, Bolbitis aliena, Bolbitis angustipinna, Bolbitis appendiculata, Bolbitis auriculata, Bolbitis bernoullii, Bolbitis bipinnatifida, Bolbitis cadieri, Bolbitis christensenii, Bolbitis confertifolia, Bolbitis costata, Bolbitis crispatula, Bolbitis fluviatilis, Bolbitis gaboonensis, Bolbitis gemmifera, Bolbitis hainanensis, Bolbitis hastata, Bolbitis hekouensis, Bolbitis hemiotis, Bolbitis heteroclita, Bolbitis heudelotii, Bolbitis humblotii, Bolbitis interlineata, Bolbitis latipinna, Bolbitis laxireticulata, Bolbitis lindigii, Bolbitis lonchophora, Bolbitis longiflagellata, Bolbitis major, Bolbitis media, Bolbitis nicotianifolia, Bolbitis nodiflora, Bolbitis novoguineensis, Bolbitis oligarchica, Bolbitis palustris, Bolbitis pandurifolia, Bolbitis pergamentacea, Bolbitis portoricensis, Bolbitis presliana, Bolbitis quoyana, Bolbitis rawsonii, Bolbitis repanda, Bolbitis rhizophylla, Bolbitis riparia, Bolbitis rivularis, Bolbitis sagenioides, Bolbitis salicina, Bolbitis scalpturata, Bolbitis scandens, Bolbitis semicordata, Bolbitis semipinnatifida, Bolbitis serrata, Bolbitis serratifolia, Bolbitis simplex, Bolbitis sinensis, Bolbitis singaporensis, Bolbitis sinuata, Bolbitis subcordata, Bolbitis subcrenata, Bolbitis taylorii, Bolbitis tibetica, Bolbitis tonkinensis, Bolbitis umbrosa, Bolbitis vanuaensis,* and *Bolbitis virens.*

In some embodiments the nucleic acid molecule encoding a PtIP-65 polypeptide is derived from a fern species in the Order Polypodiales, Family Lomariopsidaceae, Genus *Nephrolepis.* In some embodiments the nucleic acid molecule encoding a PtIP-65 polypeptide is derived from a fern species in the Order Polypodiales, Family Lomariopsidaceae, Genus *Nephrolepis* is selected from but not limited to *Nephrolepis abrupta, Nephrolepis acuminata, Nephrolepis acutifolia, Nephrolepis arida, Nephrolepis arthropteroides, Nephrolepis biserrata* var. *auriculata, Nephrolepis brownii, Nephrolepis celebica, Nephrolepis clementis, Nephrolepis cordifolia, Nephrolepis davalliae, Nephrolepis davallioides, Nephrolepis dayakorum, Nephrolepis delicatula, Nephrolepis dicksonioides, Nephrolepis duffii, Nephrolepis exaltata* ssp. *exaltata* ssp. *Hawaiiensis, Nephrolepis falcate, Nephrolepis falciformis, Nephrolepis glabra, Nephrolepis hirsutula, Nephrolepis humatoides, Nephrolepis iridescens, Nephrolepis kurotawae, Nephrolepis laurifolia, Nephrolepis lauterbachii, Nephrolepis lindsayae, Nephrolepis multifida, Nephrolepis multiflora, Nephrolepis niphobo-*

*loides, Nephrolepis obliterate, Nephrolepis paludosa, Nephrolepis pectinate, Nephrolepis pendula, Nephrolepis persicifolia, Nephrolepis pickelii, Nephrolepis pilosula, Nephrolepis pubescens, Nephrolepis pumicicola, Nephrolepis radicans, Nephrolepis rivularis, Nephrolepis rosenstockii, Nephrolepis saligna, Nephrolepis schlechteri, Nephrolepis serrate, Nephrolepis thomsoni, Nephrolepis undulate* var. *aureoglandulosa, Nephrolepis×averyi, Nephrolepis× copelandii,* and *Nephrolepis×medlerae.*

In some embodiments the nucleic acid molecule encoding a PtIP-65 polypeptide is derived from a fern species in the Order Polypodiales, Family Polypodiaceae Genus *Campyloneurum*, Genus *Drynaria*, Genus *Lepisorus*, Genus *Microgramma*, Genus *Microsorum*, Genus *Neurodium*, Genus *Niphidium*, Genus *Pecluma* M.G., Genus *Phlebodium*, Genus *Phymatosorus*, Genus *Platycerium*, Genus *Pleopeltis*, Genus *Polypodium* L.

In some embodiments the nucleic acid molecule encoding a PtIP-65 polypeptide is derived from a fern species in the Order Polypodiales, Family Polypodiaceae, Genus *Polypodium* L. In some embodiments the nucleic acid molecule encoding a PtIP-65 polypeptide is derived from a fern species in the Order Polypodiales, Family Polypodiaceae, Genus *Polypodium* L. selected from but not limited to *Polypodium absidatum, Polypodium acutifolium, Polypodium adiantiforme, Polypodium aequale, Polypodium affine, Polypodium albidopaleatum, Polypodium alcicorne, Polypodium alfarii, Polypodium alfredii, Polypodium alfredii* var. *curtii, Polypodium allosuroides, Polypodium alsophilicola, Polypodium amamianum, Polypodium amoenum, Polypodium amorphum, Polypodium anetioides, Polypodium anfractuosum, Polypodium anguinum, Polypodium angustifolium* f. *remotifolia, Polypodium angustifolium* var. *amphostenon, Polypodium angustifolium* var. *heterolepis, Polypodium angustifolium* var. *monstrosa, Polypodium angustipaleatum, Polypodium angustissimum, Polypodium anisomeron* var. *pectinatum, Polypodium antioquianum, Polypodium aoristisorum, Polypodium apagolepis, Polypodium apicidens, Polypodium apiculatum, Polypodium apoense, Polypodium appalachianum, Polypodium appressum, Polypodium arenarium, Polypodium argentinum, Polypodium argutum, Polypodium armaturn, Polypodium aromaticum, Polypodium aspersum, Polypodium assurgens, Polypodium atrum, Polypodium auriculatum, Polypodium balaonense, Polypodium balliviani, Polypodium bamleri, Polypodium bangii, Polypodium bartlettii, Polypodium basale, Polypodium bemoullii, Polypodium biauritum, Polypodium bifrons, Polypodium blepharodes, Polypodium bolivari, Polypodium bolivianum, Polypodium bolobense, Polypodium bombycinum, Polypodium bombycinum* var. *insularum, Polypodium bradeorum, Polypodium bryophilum, Polypodium bryopodum, Polypodium buchtienii, Polypodium buesii, Polypodium bulbotrichum, Polypodium caceresii, Polypodium californicum* f. *brauscombii, Polypodium californicum* f. *parsonsiae, Polypodium californicum, Polypodium calophlebium, Polypodium calvum, Polypodium camptophyllarium* var. *abbreviatum, Polypodium capitellatum, Polypodium carpinterae, Polypodium chachapoyense, Polypodium chartaceum, Polypodium chimantense, Polypodium chiricanum, Polypodium choquetangense, Polypodium christensenii, Polypodium christii, Polypodium chrysotrichum, Polypodium ciliolepis, Polypodium cinerascens, Polypodium collinsii, Polypodium colysoides, Polypodium confluens, Polypodium conforme, Polypodium confusum, Polypodium congregatifolium, Polypodium connellii, Polypodium consimile* var. *bourgaeanum, Polypodium consimile* var. *minor, Polypodium conterminans, Polypodium contiguum, Polypodium cookii, Polypodium coriaceum, Polypodium coronans, Polypodium costaricense, Polypodium costatum, Polypodium crassifolium* f. *angustissimum, Polypodium crassifolium* var. *longipes, Polypodium crassulum, Polypodium craterisorum, Polypodium cryptum, Polypodium crystalloneuron, Polypodium cucullaturn* var. *planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeraranum, Polypodium denticulatum, Polypodium diaphanum, Polypodium dilatatum, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis* var. *villosum, Polypodium exornans, Polypodium falcoideum, Polypodium fallacissimum, Polypodium farinosum, Polypodium faucium, Polypodium feet Polypodium ferrugineum, Polypodium feuillei, Polypodium firmulum, Polypodium firmum, Polypodium flaccidum, Polypodium flagellare, Polypodium flexuosum, Polypodium flexuosum* var. *ekmanii, Polypodium forbesii, Polypodium formosanum, Polypodium fraxinifolium* subsp. *articulatum, Polypodium fraxinifolium* subsp. *luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum* var. *simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens* var. *subdentatum, Polypodium insidiosum, Polypodium insigne, Polypodium intermedium* subsp. *masafueranum* var. *obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri* var. *costaricense, Polypodium lachniferum* f. *incurvata, Polypodium lachniferum* var. *glabrescens, Polypodium lachnopus, Polypodium lanceolatum* var. *complanatum, Polypodium lanceolatum* var. *trichophorum, Polypodium latevagans, Polypodium laxifrons, Polypodium laxifrons* var. *lividum, Polypodium lehmannianum, Polypodium leiorhizum, Polypodium leptopodon, Polypodium leuconeuron* var. *angustifolia, Polypodium leuconeuron* var. *latifolium, Polypodium leucosticta, Polypodium limulum, Polypodium lindigii, Polypodium lineatum, Polypodium lomarioides, Polypodium longifrons, Polypodium loretense, Polypodium loriceum* var. *umbraticum, Polypodium loriforme, Polypodium loxogramme* f. *gigas, Polypodium ludens, Polypodium luzonicum, Polypodium lycopodioides* f. *obtusum, Polypodium lycopodioides* L., *Polypodium macrolepis, Polypodium* macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalolepis, Polypodium melanotrichum, Polypodium menisciifolium var. pubescens, Polypodium meniscioides, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme var. minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum var. latior, Polypodium nubrigenum, Polypodium oligolepis, Polypodium oligosorum, Polypodium oligosorum, Polypodium olivaceum, Polypodium olivaceum var. elatum, Polypodium oodes, Polypodium oosphaerum, Polypodium oreophilum, Polypodium ornatissimum, Polypodium ornatum, Polypodium ovatum, Polypodium oxylobum, Polypodium oxypholis, Polypodium pakkaense, Polypodium pallidum, Polypodium palmatopedatum, Polypodium palmeri, Polypodium panamense, Polypodium parvum, Polypodium patagonicum, Polypodium paucisorum, Polypodium pavonianum, Polypodium pectinatum var. caliense, Polypodium pectinatum var. hispidum, Polypodium pellucidum, Polypodium pendulum var. boliviense, Polypodium percrassum, Polypodium perpusillum, Polypodium peruvianum var. subgibbosum, Polypodium phyllitidis var. elongatum, Polypodium pichinchense, Polypodium pilosissimum, Polypodium pilosissimum var. glabriusculum, Polypodium pilossimum var. tunguraquensis, Polypodium pityrolepis, Polypodium platyphyllum, Polypodium playfairii, Polypodium plebeium var. cooperi, Polypodium plectolepidioides, Polypodium pleolepis, Polypodium plesiosorum var.i, Polypodium podobasis, Polypodium podocarpum, Polypodium poloense, Polypodium polydatylon, Polypodium polypodioides var. aciculare, Polypodium polypodioides var. michauxianum, Polypodium praetermissum, Polypodium preslianum var. immersum, Polypodium procerum, Polypodium procerum, Polypodium productum, Polypodium productum, Polypodium prolongilobum, Polypodium propinguum, Polypodium proteus, Polypodium pruinatum, Polypodium pseudocapillare, Polypodium pseudofratemum, Polypodium pseudonutans, Polypodium pseudoserratum, Polypodium pulcherrimurn, Polypodium pulogense, Polypodium pungens, Polypodium purpusii, Polypodium radicale, Polypodium randallii, Polypodium ratiborii, Polypodium reclinaturn, Polypodium recreense, Polypodium repens var. abruptum, Polypodium revolvens, Polypodium rhachipterygium, Polypodium rhomboideum, Polypodium rigens, Polypodium robustum, Polypodium roraimense, Polypodium roraimense, Polypodium rosei, Polypodium rosenstockii, Polypodium rubidum, Polypodium rudimentum, Polypodium rusbyi, Polypodium sablanianum, Polypodium sarmentosum, Polypodium saxicola, Polypodium schenckii, Polypodium schlechteri, Polypodium scolopendria, Polypodium scolopendria, Polypodium scolopendrium, Polypodium scouleri, Polypodium scutulatum, Polypodium segregatum, Polypodium semihirsutum, Polypodium semihirsutum var. fuscosetosum, Polypodium senile var. minor, Polypodium sericeolanatum, Polypodium serraeforme, Polypodium serricula, Polypodium sesquipedala, Polypodium sessilifolium, Polypodium setosum var. calvum, Polypodium setulosum, Polypodium shaferi, Polypodium sibomense, Polypodium siccum, Polypodium simacense, Polypodium simulans, Polypodium singeri, Polypodium sinicum, Polypodium sintenisii, Polypodium skutchii, Polypodium sloanei, Polypodium sodiroi, Polypodium sordidulum, Polypodium sordidum, Polypodium sphaeropteroides, Polypodium sphenodes, Polypodium sprucei, Polypodium sprucei var. furcativenosa, Polypodium steirolepis, Polypodium stenobasis, Polypodium stenolepis, Polypodium stenopterum, Polypodium subcapillare, Polypodium subflabelliforme, Polypodium subhemionitidium, Polypodium subinaequale, Polypodium subintegrum, Polypodium subspathulatum, Polypodium subtile, Polypodium subvestitum, Polypodium subviride, Polypodium superficiale var. attenuatum, Polypodium superficiale var. chinensis, Polypodium sursumcurrens, Polypodium tablazianurn, Polypodium taenifolium, Polypodium tamandarei, Polypodium tatei, Polypodium tenuiculum var. acrosora, Polypodium tenuiculum var. brasiliense, Polypodium tenuilore, Polypodium tenuinerve, Polypodium tepuiense, Polypodium teresae, Polypodium tetragonum var. incompletum, Polypodium thysanolepis var. bipinnatifidum, Polypodium thyssanolepis, var. thyssanolepis, Polypodium thyssanolepsi, Polypodium tobagense, Polypodium trichophyllum, Polypodium tridactylum, Polypodium tridentatum, Polypodium trifurcaturn var. brevipes, Polypodium triglossum, Polypodium truncatulum, Polypodium truncicola var. major, Polypodium truncicola var. minor, Polypodium tuberosum, Polypodium tunguraguae, Polypodium turquinurn, Polypodium turrialbae, Polypodium ursipes, Polypodium vagans, Polypodium valdealaturn, Polypodium versteegii, Polypodium villagranii, Polypodium virginianum f. cambroideum, Polypodium virginianurn f. peraferens, Polypodium vittarioides, Polypodium vulgare, Polypodium vulgare L., Polypodium vulgare subsp. oreophilum, Polypodium vulgare var. acuminatum, Polypodium vulpinum, Polypodium williamsii, Polypodium wobbense, Polypodium×fallacissimum-guttatum, Polypodium xantholepis, Polypodium xiphopteris, Polypodium yarumalense, Polypodium yungense, and Polypodium zosteriforme.

In some embodiments the PtIP-65 polypeptide is derived from a fern species in the Order Polypodiales, Family Polypodiaceae, Genus Platycerium. In some embodiments the PtIP-65 polypeptide is derived from a fern species in the Order Polypodiales, Family Polypodiaceae, Genus Platycerium selected from but not limited to Platycerium alcicorne, Platycerium andinum, Platycerium angolense, Platycerium bifurcatum, Platycerium coronarium, Platycerium elephantotis, Platycerium ellisii, Platycerium grande, Platycerium hillii, Platycerium holtturnii, Platycerium madagascariense, Platycerium quadridichotomum, Platycerium ridleyi, Platycerium sp. ES-2011, Platycerium stemaria, Platycerium superbum, Platycerium veitchii, Platycerium wallichii, Platycerium wandae, Platycerium wilhelminae-reginae, and Platycerium willinckii.

In some embodiments the nucleic acid molecule encoding a PtIP-65 polypeptide is derived from a species in the Division Lycophyta.

In some embodiments the nucleic acid molecule encoding a PtIP-65 polypeptide is derived from a species in the Class Isoetopsida or Class Lycopodiopsida. In some embodiments the nucleic acid molecule encoding a PtIP-65 polypeptide is derived from a species in the Class Isoetopsida Order Selaginales. In some embodiments the nucleic acid molecule encoding a PtIP-65 polypeptide is derived from a fern species in the Class Isoetopsida, Order Selaginales, Family Selaginellaceae. In some embodiments the nucleic acid molecule encoding a PtIP-65 polypeptide is derived from a species in the Genus *Selaginella*. In some embodiments the nucleic acid molecule encoding a PtIP-65 polypeptide is derived from a *Selaginella* species selected from but not limited to *Selaginella acanthonota, Selaginella apoda, Selaginella arbuscula, Selaginella arenicola, Selaginella arizonica, Selaginella armata, Selaginella asprella, Selaginella biformis, Selaginella bigelovii, Selaginella braunii, Selaginella cinerascens, Selaginella cordifolia, Selaginella deflexa, Selaginella delicatula, Selaginella densa, Selaginella douglasii, Selaginella eatonii, Selaginella eclipes, Selaginella eremophila, Selaginella erythropus, Selaginella flabellata, Selaginella hansenii, Selaginella heterodonta, Selaginella kraussiana, Selaginella krugii, Selaginella laxifolia, Selaginella lepidophylla, Selaginella leucobryoides, Selaginella ludoviciana, Selaginella mutica, Selaginella oregana, Selaginella ovifolia, Selaginella pallescens, Selaginella peruviana, Selaginella pilifera, Selaginella plana, Selaginella plumosa, Selaginella pulcherrima, Selaginella rupestris, Selaginella rupincola, Selaginella scopulorum, Selaginella selaginoides, Selaginella sibirica, Selaginella standleyi, Selaginella stellata, Selaginella subcaulescens, Selaginella substipitata, Selaginella tenella, Selaginella tortipila, Selaginella uliginosa, Selaginella umbrosa, Selaginella uncinata, Selaginella underwoodii, Selaginella utahensis, Selaginella victoriae, Selaginella viridissima, Selaginella wallacei, Selaginella watsonii, Selaginella weatherbiana, Selaginella willdenowii, Selaginella wrightii and Selaginella×neomexicana*.

In some embodiments the nucleic acid molecule encoding a PtIP-65 polypeptide is derived from a species in the Class Lycopodiopsida, Order Lycopodiales. In some embodiments the nucleic acid molecule encoding a PtIP-65 polypeptide is derived from a fern species in the Class Lycopodiopsida, Order Lycopodiales Family Lycopodiaceae or Family Huperziaceae. In some embodiments the nucleic acid molecule encoding a PtIP-65 polypeptide is derived from a species in the Genus *Austrolycopodium, Dendrolycopodium, Diphasiastrum, Diphasium, Huperzia, Lateristachys, Lycopodiastrum, Lycopodiella, Lycopodium, Palhinhaea, Pseudodiphasium, Pseudolycopodiella, Pseudolycopodium* or *Spinulum*.

In some embodiments the nucleic acid molecule encoding a PtIP-65 polypeptide is derived from a species in the Genus *Lycopodium*. In some embodiments the nucleic acid molecule encoding a PtIP-65 polypeptide is derived from a *Lycopodium* species selected from but not limited to *Lycopodium alpinum* L., *Lycopodium annotinum* L., *Lycopodium clavatum* L., *Lycopodium complanatum* L., *Lycopodium dendroideum* Michx., *Lycopodium digitatum, Lycopodium xhabereri, Lycopodium hickeyi, Lycopodium×issleri, Lycopodium lagopus, Lycopodium obscurum* L., *Lycopodium phlegmaria* L., *Lycopodium sabinifolium, Lycopodium sitchense, Lycopodium tristachyum, Lycopodium venustulum, Lycopodium venustulum* var. *venustulum, Lycopodium venustulum* var. *verticale, Lycopodium volubile* and *Lycopodium×zeilleri*.

In some embodiments the nucleic acid molecule encoding a PtIP-65 polypeptide is derived from a species in the Genus *Huperzia*. In some embodiments the nucleic acid molecule encoding a PtIP-65 polypeptide is derived from a species selected from but not limited to *Huperzia appressa, Huperzia arctica, Huperzia attenuata, Huperzia australiana, Huperzia balansae, Huperzia billardierei, Huperzia brassii, Huperzia campiana, Huperzia capellae, Huperzia carinata, Huperzia* cf. *carinata* ARF000603, *Huperzia* cf. *nummulariifolia* ARF001140, *Huperzia* cf. *phlegmaria* ARF000717, *Huperzia* cf. *phlegmaria* ARF000000, *Huperzia* cf. *phlegmaria* ARF000771, *Huperzia* cf. *phlegmaria* ARF000785, *Huperzia* cf. *phlegmaria* ARF001007, *Huperzia* cf. *phlegmaria* ARF002568, *Huperzia* cf. *phlegmaria* ARF002703, *Huperzia* cf. *phlegmaria* Wikstrom 1998, *Huperzia chinensis, Huperzia compacta, Huperzia crassa, Huperzia crispata, Huperzia cryptomeriana, Huperzia cumingii, Huperzia dacrydioides, Huperzia dalhousieana, Huperzia dichotoma, Huperzia emeiensis, Huperzia ericifolia, Huperzia eversa, Huperzia fargesii, Huperzia fordii, Huperzia funiformis, Huperzia goebellii, Huperzia haleakalae, Huperzia hamiltonii, Huperzia heteroclita, Huperzia hippuridea, Huperzia hippuris, Huperzia holstii, Huperzia horizontalis, Huperzia hunanensis, Huperzia hystrix, Huperzia lindenii, Huperzia linifolia, Huperzia lockyeri, Huperzia lucidula, Huperzia mingcheensis, Huperzia miyoshiana, Huperzia nanchuanensis, Huperzia nummulariifolia, Huperzia obtusifolia, Huperzia ophioglossoides, Huperzia petiolate, Huperzia phlegmaria, Huperzia phlegmarioides, Huperzia phyllantha, Huperzia pinifolia, Huperzia polydactyla, Huperzia prolifera, Huperzia reflexa, Huperzia rosenstockiana, Huperzia rufescens, Huperzia salvinoides, Huperzia sarmentosa, Huperzia selago, Huperzia serrata, Huperzia sieboldii, Huperzia somae, Huperzia squarrosa, Huperzia subulata, Huperzia sutchueniana, Huperzia tauri, Huperzia taxifolia, Huperzia tenuis, Huperzia tetragona, Huperzia tetrasticha, Huperzia unguiculata, Huperzia varia, Huperzia verticillata* and *Huperzia wilsonii*.

In some embodiments the nucleic acid molecule encodes a PtIP-65 polypeptide comprising an amino acid sequence motif 6 as represented by an amino acid sequence of the formula R[GL][SE]YSE[FY]TFA[DET]GERIT (SEQ ID NO: 152).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); and at least one amino acid sequence motif selected from: i) an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW]RQ][IL][KR][AG]I[RES]VW[LM] (SEQ ID NO: 148); and ii) an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW]RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); and at least one amino acid sequence motif selected from: i) an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); ii) an amino acid sequence motif 5 as represented by an amino acid sequence of the formula [GQ][ILF][EIT][ATV][HT][AS]S[VI][TS]V[QES]A[GR] IP[AS][VL]AEV[SN]G[EV][FV]GW[SEQ][VI]S[VA][ST] (SEQ ID NO: 151); iii) an amino acid sequence motif 12 as represented by an amino acid sequence of the formula [LM][AVY][QL][TV][PI][VG][YT][VL]IGGQGG[SN] [AQS](SEQ ID NO: 158); and iv) an amino acid sequence motif 16 as represented by an amino acid sequence of the formula [AVS]SG[ILV][CW][VA]G[IVLF][TILMR] (SEQ ID NO: 162).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ] [GSE][TR][DN]G[RK]V[LM][QTR][RK]I[GR]V[WY] [AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I [QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG] I[RY]F[YER]T[TNS][TQ][GN][GR][SRT]F[FD][FPH] [GK]M[TY]SWG[LK][KQ]TEYP[IVQ]DV (SEQ ID NO: 147); an amino acid sequence motif 5 as represented by an amino acid sequence of the formula [GQ][ILF][EIT][ATV] [HT][AS]S[VI][TS]V[QES]A[GR]IP[AS][VL]AEV[SN]G [EV][FV]GW[SEQ][VI]S[VA][ST] (SEQ ID NO: 151); an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 16 as represented by an amino acid sequence of the formula [AVS]SG[ILV][CW][VA]G [IVLF][TILMR] (SEQ ID NO: 162); and at least one amino acid sequence motif selected from: i) an amino acid sequence motif 11 as represented by an amino acid sequence of the formula K[ST]F[NT]L[QGL]N[TA]A[DHN][QH] [DE]D[PQ]SST[EQ][QK]LAW[EQ]LADEP[SR]FDNV [SF][HL][ST]W[SI]LSN (SEQ ID NO: 157); ii) an amino acid sequence motif 17 as represented by an amino acid sequence of the formula D[GE][VA][QEA][KQR][TL]F-GDP[SH][RD]P[APS]GE (SEQ ID NO: 163); iii) an amino acid sequence motif 20 as represented by an amino acid sequence of the formula DT[QE]SSSLSSSSSL[LS]LPWSR [NS]GSLLPS[EKQ]S[LF] (SEQ ID NO: 166); iv) an amino acid sequence motif 24 as represented by an amino acid sequence of the formula [AQ][RV][VT]TT[ST][GH][GS] [TR]FSF[SP]GL[QHK]G[AFLR][FY]TG[QE]S[HY][VA] [IP][AD][IV]T[TAS]Q (SEQ ID NO: 170); and v) an amino acid sequence motif 26 as represented by an amino acid sequence of the formula L[SV]AL[PT][YFR][RDGQ]G[N-DIT][VAL][NSR][GDN]L[PFRS]F[NDET] (SEQ ID NO: 171).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ] [GSE][TR][DN]G[RK]V[LM][QTR][RK]I[GR]V[WY] [AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I [QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG] I[RY]F[YER]T[TNS][TQ][GN][GR][SRT]F[FD][FPH] [GK]M[TY]SWG[LK][KQ]TEYP[IVQ]DV (SEQ ID NO: 147); an amino acid sequence motif 5 as represented by an amino acid sequence of the formula [GQ][ILF][EIT][ATV] [HT][AS]S[VI][TS]V[QES]A[GR]IP[AS][VL]AEV[SN]G [EV][FV]GW[SEQ][VI]S[VA][ST] (SEQ ID NO: 151); an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 16 as represented by an amino acid sequence of the formula [AVS]SG[ILV][CW][VA]G [IVLF][TILMR] (SEQ ID NO: 162); an amino acid sequence motif 11 as represented by an amino acid sequence of the formula K[ST]F[NT]L[QGL]N[TA]A[DHN][QH] [DE]D[PQ]SST[EQ][QK]LAW[EQ]LADEP[SR]FDNV [SF][HL][ST]W[SI]LSN (SEQ ID NO: 157); an amino acid sequence motif 17 as represented by an amino acid sequence of the formula D[GE][VA][QEA][KQR][TL]FGDP[SH] [RD]P[APS]GE (SEQ ID NO: 163); an amino acid sequence motif 20 as represented by an amino acid sequence of the formula DT[QE]SSSLSSSSSL[LS]LPWSR[NS]GSLLPS [EKQ]S[LF] (SEQ ID NO: 166); an amino acid sequence motif 24 as represented by an amino acid sequence of the formula [AQ][RV][VT]TT[ST][GH][GS][TR]FSF[SP]GL [QHK]G[AFLR][FY]TG[QE]S[HY][VA][IP][AD][IV]T [TAS]Q (SEQ ID NO: 170); and an amino acid sequence motif 26 as represented by an amino acid sequence of the formula L[SV]AL[PT][YFR][RDGQ]G[NDIT][VAL] [NSR][GDN]L[PFRS]F[NDET] (SEQ ID NO: 171).

In some embodiments the nucleic acid molecule encodes a PtIP-65 polypeptide, comprising, sequentially from the N-terminus to the C-terminus of the PtIP-65 polypeptide an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 2 as represented by an amino acid sequence of the formula F[STR]Y[DY][GQ][GSE] [TR][DN]G[RK]V[LM][QTR][RK]I[GR]V[WY][AR] [GA][ET][SW][RQ][IL][KR][AG]I[RES]VW[LM] (SEQ ID NO: 148); an amino acid sequence motif 6 as represented by an amino acid sequence of the formula R[GL][SE]YSE [FY]TFA[DET]GERIT (SEQ ID NO: 152); an amino acid sequence motif 17 as represented by an amino acid sequence of the formula D[GE][VA][QEA][KQR][TL]FGDP[SH] [RD]P[APS]GE (SEQ ID NO: 163); an amino acid sequence motif selected from: an amino acid sequence motif 1 as represented by an amino acid sequence of the formula RLSLWGNGAGTR[SA]G[WAG]I[RY]F[YER]T[TNS] [TQ][GN][GR][SRT]F[FD][FPH][GK]M[TY]SWG[LK] [KQ]TEYP[IVQ]DV (SEQ ID NO: 147); an amino acid sequence motif 16 as represented by an amino acid sequence of the formula [AVS]SG[ILV][CW][VA]G[IVLF][TILMR] (SEQ ID NO: 162); an amino acid sequence motif 3 as represented by an amino acid sequence of the formula GRA[NS][SV]D[IVL][DN][SA]LG[FV][VML]FLR[PTS]I [QA]S[AVCS]R[LM]I[NS]V[QS]YPTL (SEQ ID NO: 149); an amino acid sequence motif 11 as represented by an amino acid sequence of the formula K[ST]F[NT]L[QGL]N [TA]A[DHN][QH][DE]D[PQ]SST[EQ][QK]LAW[EQ] LADEP[SR]FDNV[SF][HL][ST]W[SI]LSN (SEQ ID NO: 157); an amino acid sequence motif 5 as represented by an amino acid sequence of the formula [GQ][ILF][EIT][ATV] [HT][AS]S[VI][TS]V[QES]A[GR]IP[AS][VL]AEV[SN]G

[EV][FV]GW[SEQ][VI]S[VA][ST] (SEQ ID NO: 151); an amino acid sequence motif 20 as represented by an amino acid sequence of the formula DT[QE]SSSLSSSSSL[LS]LPWSR[NS]GSLLPS[EKQ]S[LF](SEQ ID NO: 166); an amino acid sequence motif 26 as represented by an amino acid sequence of the formula L[SV][AL[PT][YFR][RDGQ]G[NDIT][VAL][NSR][GDN]L[PFRS]F[NDET] (SEQ ID NO: 171) and an amino acid sequence motif 24 as represented by an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 16 as represented by an amino acid sequence of the formula [AVS]SG[ILV][CW][VA]G[IVLF][TILMR] (SEQ ID NO: 162); and at least one amino acid sequence motif selected from: i) an amino acid sequence motif 8 as represented by an amino acid sequence of the formula [QG][EV][GK]D[HQ][NS]VQP[ND]KE[V-A][EKQ]E[CRS][KT][LV]LF[AIT]E (SEQ ID NO: 154); ii) an amino acid sequence motif 13 as represented by an amino acid sequence of the formula GVDYTSVDI[TV][NS][TQ]GTR[AD] (SEQ ID NO: 159); iii) an amino acid sequence motif 19 as represented by an amino acid sequence of the formula [TS]G[DSTN][DS][TSN]P[AHYRIAT][TVL][FY-C]G[TS][APV] (SEQ ID NO: 165); iv) an amino acid sequence motif 22 as represented by an amino acid sequence of the formula [KLS][DKN][EHQ]VEV[EQ]A[TV][DE]QQ (SEQ ID NO: 168); and v) an amino acid sequence motif 23 as represented by an amino acid sequence of the formula Y[TA][ST]TQEESRTLT (SEQ ID NO: 169).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 16 as represented by an amino acid sequence of the formula [AVS]SG[ILV][CW][VA]G[IVLF][TILMR] (SEQ ID NO: 162); an amino acid sequence motif 8 as represented by an amino acid sequence of the formula [QG][EV][GK]D[HQ][NS]VQP[ND]KE[V-A][EKQ]E[CRS][KT][LV]LF[AIT]E (SEQ ID NO: 154); an amino acid sequence motif 13 as represented by an amino acid sequence of the formula GVDYTSVDI[TV][NS][TQ]GTR[AD] (SEQ ID NO: 159); an amino acid sequence motif 19 as represented by an amino acid sequence of the formula [TS]G[DSTN][DS][TSN]P[AHYRIAT][TVL][FYC]G[TS][APV] (SEQ ID NO: 165); an amino acid sequence motif 22 as represented by an amino acid sequence of the formula [KLS][DKN][EHQ]VEV[EQ]A[TV][DE]QQ (SEQ ID NO: 168); an amino acid sequence motif 23 as represented by an amino acid sequence of the formula Y[TA][ST]TQEESRTLT (SEQ ID NO: 169); and at least one amino acid sequence motif selected from: i) an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); ii) an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); and iii) an amino acid sequence motif 15 as represented by an amino acid sequence of the formula [LF][ED][QT][AQ]GI[IVST]P[VITQ][TA]L[DK] (SEQ ID NO: 161).

In some embodiments the nucleic acid molecule encodes a PtIP-65 polypeptide, comprising, sequentially from the N-terminus to the C-terminus of the PtIP-65 polypeptide, an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 19 as represented by an amino acid sequence of the formula [TS]G[DSTN][DS][TSN]P[AHYRIAT][TVL][FYC]G[TS][APV] (SEQ ID NO: 165); an amino acid sequence motif 6 as represented by an amino acid sequence of the formula R[GL][SE]YSE[FY]TFA[DET]GERIT (SEQ ID NO: 152); an amino acid sequence motif selected from: an amino acid sequence motif 1 as represented by an amino acid sequence of the formula RLSLWGNGAGTR[SA]G[WAG]I[RY]F[Y-ER]T[TNS][TQ][GN][GR][SRT]F[FD][FPH][GK]M[TY]SWG[LK][KQ]TEYP[IVQ]DV (SEQ ID NO: 147); an amino acid sequence motif 16 as represented by an amino acid sequence of the formula [AVS]SG[ILV][CW][VA]G[IVLF][TILMR] (SEQ ID NO: 162); an amino acid sequence motif 3 as represented by an amino acid sequence of the formula GRA[NS][SV]D[IVL][DN][SA]LG[FV]

[VML]FLR[PTS]I[QA]S[AVCS]R[LM]I[NS]V[QS]YPTL (SEQ ID NO: 149); an amino acid sequence motif 15 as represented by an amino acid sequence of the formula [LF][ED][QT][AQ]GI[IVST]P[VITQ][TA]L[DK] (SEQ ID NO: 161); an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 23 as represented by an amino acid sequence of the formula Y[TA][ST]TQEESRTLT (SEQ ID NO: 169); an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); an amino acid sequence motif 13 as represented by an amino acid sequence of the formula GVDYTSVDI[TV][NS][TQ]GTR[AD] (SEQ ID NO: 159); an amino acid sequence motif 22 as represented by an amino acid sequence of the formula [KLS][DKN][EHQ]VEV[EQ]A[TV][DE]QQ (SEQ ID NO: 168); and an amino acid sequence motif 8 as represented by an amino acid sequence of the formula [QG][EV][GK]D[HQ][NS]VQP[ND]KE[VA][EKQ]E[CRS][KT][LV]LF[AIT]E (SEQ ID NO: 154).

In some embodiments the nucleic acid molecule encodes a PtIP-65 polypeptide, comprising, sequentially from the N-terminus to the C-terminus of the PtIP-65 polypeptide: an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 19 as represented by an amino acid sequence of the formula [TS]G[DSTN][DS][TSN]P[AHYRIAT][TVL][FYC]G[TS][APV] (SEQ ID NO: 165); an amino acid sequence motif 6 as represented by an amino acid sequence of the formula R[GL][SE]YSE[FY]TFA[DET]GERIT (SEQ ID NO: 152); an amino acid sequence motif 10 as represented by an amino acid sequence of the formula [WPY][DTN][HNV][VI][AG]R[VI][RW]F[SQ]TS[RL][GL]R[TI]FE[YF]G[SM][ST][RV][EQ]P[ST]G[QKR][WV][FIT][TE][VA]NVGS-GVCVG[VM] (SEQ ID NO: 156); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 27 as represented by an amino acid sequence of the formula T[TFPS]IL[EQS][EQH]LP[DA] (SEQ ID NO: 172); an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 21 as represented by an amino acid sequence of the formula HL[TV][GA][NRS][AND]I[STL][IVL][ND][VILM][DTS]LGI[ND][TA]P[TK][VI]V[PA] (SEQ ID NO: 167); an amino acid sequence motif 18 as represented by an amino acid sequence of the formula G[TLP][AE]GAST[NTA]F[GQH]W[EQ]T[VA]R[TA]FPS[TIS]NA (SEQ ID NO: 164); an amino acid sequence motif 9 as represented by an amino acid sequence of the formula [IMV][QE]G[ST]I[AS][ND]L[TI]V[SRT]T[NAD][EA]YSVW[CG]H[IV]SDT[LVI]APAQ[SL][LI][PI][K S][HR][RASV]A (SEQ ID NO: 155); an amino acid sequence motif 14 as represented by an amino acid sequence of the formula [LW][VI]GEG[RS]I[TD][AN]L[PQ]CSA[NR]QV[FIL]T[SD][GAS][GAD][NGY][NDG][LF]PF[AG][TS]F[ST]FPV[RGQ][LSV][LF]Y[DNS][GA][GR]AHS[DNQT]VQ[VI][LI] (SEQ ID NO: 160).

In some embodiments the nucleic acid molecule encodes a PtIP-65 polypeptide, comprising an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 as represented by an amino acid sequence of the formula [LM][AVY][QL][TV][PI][V-G][YT][VL]IGGQGG[SN][AQS] (SEQ ID NO: 158); an amino acid sequence motif 16 as represented by an amino acid sequence of the formula [AVS]SG[ILV][CW][VA]G[IVLF][TILMR] (SEQ ID NO: 162); and at least one amino acid sequence motif selected from: i) an amino acid sequence motif 17 as represented by an amino acid sequence of the formula D[GE][VA][QEA][KQR][TL]FGDP[SH][RD]P[APS]GE (SEQ ID NO: 163); ii) an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); iii) an amino acid sequence motif 7 as represented by an amino acid sequence of the formula [NT]D[SK]NN[AD][GDS]S[IE][PS][KL]N-W[TV][FL][SA]GSR[TQ]VT[ITV]SS[ST]W[STR][LT]T (SEQ ID NO: 153); and iv) an amino acid sequence motif 15 as represented by an amino acid sequence of the formula [LF][ED][QT][AQ]GI[IVST]P[VITQ][TA]L[DK] (SEQ ID NO: 161).

In some embodiments the nucleic acid molecule encodes a PtIP-65 polypeptide, comprising sequentially from the N-terminus to the C-terminus of the PtIP-65 polypeptide: an amino acid sequence motif 12 as represented by an amino acid sequence of the formula [LM][AVY][QL][TV][P][TV][P][VG][YT][VL]IGGQGG[SN][AQS] (SEQ ID NO: 158); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 6 as represented by an amino acid sequence of the formula R[GL][SE]YSE[FY]TFA[DET]GERIT (SEQ ID NO: 152); an amino acid sequence motif 17 as represented by an amino acid sequence of the formula D[GE][VA][QEA][KQR][TL]FGDP[SH][RD]P[APS]GE (SEQ ID NO: 163); an amino acid sequence motif selected from: an amino acid sequence motif 1 as represented by an amino acid sequence of the formula RLSLWGNGAGTR[SA]G[WAG]I[RY]F[YER]T[TNS]

[TQ][GN][GR][SRT]F[FD][FPH][GK]M[TY]SWG[LK][KQ]TEYP[IVQ]DV (SEQ ID NO: 147); an amino acid sequence motif 16 as represented by an amino acid sequence of the formula [AVS]SG[ILV][CW][VA]G[IVLF][TILMR] (SEQ ID NO: 162); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 15 as represented by an amino acid sequence of the formula [LF][ED][QT][AQ]GI[IVST]P[VITQ][TA]L[DK] (SEQ ID NO: 161); an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); and an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150).

In some embodiments the nucleic acid molecule encodes a PtIP-65 polypeptide comprising an amino acid sequence motif 6 having at least 90% identity to an amino acid sequence of the formula R[GL][SE]YSE[FY]TFA[DET]GERIT (SEQ ID NO: 152).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); and at least one amino acid sequence motif selected from: i) an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); and ii) an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); and at least one amino acid sequence motif selected from: i) an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); ii) an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); iii) an amino acid sequence motif 12 having at least 90% identity to an amino acid sequence of the formula [LM][AVY][QL][TV][PI][VG][YT][VL]IGGQGG[SN][AQS] (SEQ ID NO: 158); and iv) an amino acid sequence motif 16 having at least 90% identity to an amino acid sequence of the formula [AVS]SG[ILV][CW][VA]G[IVLF][TILMR] (SEQ ID NO: 162).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][P][TV][P][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); and at least one amino acid sequence motif selected from: i) an amino acid sequence motif 11 having at least 90% identity to an amino acid sequence of the formula K[ST]F[NT]L[QGL]N[TA]A[DHN][QH][DE]D[PQ]SST[EQ][QK]LAW[EQ]LADEP[SR]FDNV[SF][HL][ST]W[SI]LSN (SEQ ID NO: 157); ii) an amino acid sequence motif 17 having at least 90% identity to an amino acid sequence of the formula D[GE][VA][QEA][KQR][TL]F-GDP[SH][RD]P[APS]GE (SEQ ID NO: 163); iii) an amino acid sequence motif 20 having at least 90% identity to an amino acid sequence of the formula DT[QE]SSSLSSSSSL[LS]LPWSR[NS]GSLLPS[EKQ]S[LF] (SEQ ID NO: 166); iv) an amino acid sequence motif 24 having at least 90% identity to an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170); and v) an amino acid sequence motif 26 having at least 90% identity to an amino acid sequence of the formula L[SV]AL[PT][YFR][RDGQ]G[NDIT][VAL][NSR][GDN]L[PFRS]F[NDET] (SEQ ID NO: 171).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); an amino acid sequence motif 11 having at least 90% identity to an amino acid sequence of the formula K[ST]F[NT]L[QGL]N[TA]A[DHN][QH][DE]D[PQ]SST[EQ][QK]LAW[EQ]LADEP[SR]FDNV[SF][HL][ST]W[SI]LSN (SEQ ID NO: 157); an amino acid sequence motif 17 having at least 90% identity to an amino acid sequence of the formula D[GE][VA][QEA][KQR][TL]FGDP[SH][RD]P[APS]GE (SEQ ID NO: 163); an amino acid sequence motif 20 having at least 90% identity to an amino acid sequence of the formula DT[QE]SSSLSSSSSL[LS]LPWSR[NS]GSLLPS[EKQ]S[LF] (SEQ ID NO: 166); an amino acid sequence motif 24 having at least 90% identity to an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170); and an amino acid sequence motif 26 having at least 90% identity to an amino acid sequence of the formula L[SV]AL[PT][YFR][RDGQ]G[NDIT][VAL][NSR][GDN]L[PFRS]F[NDET] (SEQ ID NO: 171).

In some embodiments the nucleic acid molecule encodes a PtIP-65 polypeptide, comprising sequentially from the N-terminus to the C-terminus of the PtIP-65 polypeptide: an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 6 having at least 90% identity to an amino acid sequence of the formula R[GL][SE]YSE[FY]TFA[DET]GERIT (SEQ ID NO: 152); an amino acid sequence motif 17 having at least 90% identity to an amino acid sequence of the formula D[GE][VA][QEA][KQR][TL]FGDP[SH][RD]P[APS]GE (SEQ ID NO: 163); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 16 having at least 90% identity to an amino acid sequence of the formula [AVS]SG[ILV][CW][VA]G[IVLF][TILMR] (SEQ ID NO: 162); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 11 having at least 90% identity to an amino acid sequence of the formula K[ST]F[NT]L[QGL]N[TA]A[DHN][QH][DE]D[PQ]SST[EQ][QK]LAW[EQ]LADEP[SR]FDNV[SF][HL][ST]W[SI]LSN (SEQ ID NO: 157); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 20 having at least 90% identity to an amino acid sequence of the formula DT[QE]SSSLSSSSSL[LS]LPWSR[NS]GSLLPS[EKQ]S[LF] (SEQ ID NO: 166); an amino acid sequence motif 26 having at least 90% identity to an amino acid sequence of the formula L[SV]AL[PT][YFR][RDGQ]G[NDIT][VAL][NSR][GDN]L[PFRS]F[NDET] (SEQ ID NO: 171) and an amino acid sequence motif 24 having at least 90% identity to an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][P][TV][P][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); and at least one amino acid sequence motif selected from: i) an amino acid sequence motif 8 having at least 90% identity to an amino acid sequence of the formula [QG][EV][GK]D[HQ][NS]VQP[ND]KE[VA][EKQ]E[CRS][KT][LV]LF[AIT]E (SEQ ID NO: 154); ii) an amino acid sequence motif 13 having at least 90% identity to an amino acid sequence of the formula GVDYTSVDI[TV][NS][TQ]GTR[AD] (SEQ ID NO: 159); iii) an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); iv) an amino acid sequence motif 22 having at least 90% identity to an amino acid sequence of the formula [KLS][DKN][EHQ]VEV[EQ]A[TV][DE]QQ (SEQ ID NO: 168); and v) an amino acid sequence motif 23 having at least 90% identity to an amino acid sequence of the formula Y[TA][ST]TQEESRTLT (SEQ ID NO: 169).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL]

[KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][P][TV][P][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); an amino acid sequence motif 8 having at least 90% identity to an amino acid sequence of the formula [QG][EV][GK]D[HQ][NS]VQP[ND]KE[VA][EKQ]E[CRS][KT][LV]LF[AIT]E (SEQ ID NO: 154); an amino acid sequence motif 13 having at least 90% identity to an amino acid sequence of the formula GVDYTSVDI[TV][NS][TQ]GTR[AD] (SEQ ID NO: 159); an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); an amino acid sequence motif 22 having at least 90% identity to an amino acid sequence of the formula [KLS][DKN][EHQ]VEV[EQ]A[TV][DE]QQ (SEQ ID NO: 168); an amino acid sequence motif 23 having at least 90% identity to an amino acid sequence of the formula Y[TA][ST]TQEESRTLT (SEQ ID NO: 169); and at least one amino acid sequence motif selected from: i) an amino acid sequence motif 4 having at least 90% identity to an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); ii) an amino acid sequence motif 7 having at least 90% identity to an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); and iii) an amino acid sequence motif 15 having at least 90% identity to an amino acid sequence of the formula [LF][ED][QT][AQ]GI[IVST]P[VITQ][TA]L[DK] (SEQ ID NO: 161).

In some embodiments the nucleic acid molecule encodes a PtIP-65 polypeptide, comprising, sequentially from the N-terminus to the C-terminus of the PtIP-65 polypeptide: an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); an amino acid sequence motif 6 having at least 90% identity to an amino acid sequence of the formula R[GL][SE]YSE[FY]TFA[DET]GERIT (SEQ ID NO: 152); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 16 having at least 90% identity to an amino acid sequence of the formula [AVS]SG[ILV][CW][VA]G[IVLF][TILMR] (SEQ ID NO: 162); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 15 having at least 90% identity to an amino acid sequence of the formula [LF][ED][QT][AQ]GI[IVST]P[VITQ][TA]L[DK] (SEQ ID NO: 161); an amino acid sequence motif 7 having at least 90% identity to an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 23 having at least 90% identity to an amino acid sequence of the formula Y[TA][ST]TQEESRTLT (SEQ ID NO: 169); an amino acid sequence motif 4 having at least 90% identity to an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); an amino acid sequence motif 13 having at least 90% identity to an amino acid sequence of the formula GVDYTSVDI[TV][NS][TQ]GTR[AD] (SEQ ID NO: 159); an amino acid sequence motif 22 having at least 90% identity to an amino acid sequence of the formula [KLS][DKN][EHQ]VEV[EQ]A[TV][DE]QQ (SEQ ID NO: 168); and an amino acid sequence motif 8 having at least 90% identity to an amino acid sequence of the formula [QG][EV][GK]D[HQ][NS]VQP[ND]KE[VA][EKQ]E[CRS][KT][LV]LF[AIT]E (SEQ ID NO: 154).

In some embodiments the nucleic acid molecule encodes a PtIP-65 polypeptide, comprising, sequentially from the N-terminus to the C-terminus of the PtIP-65 polypeptide: an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); an amino acid sequence motif 6 having at least 90% identity to an amino acid sequence of the formula R[GL][SE]YSE[FY]TFA[DET]GERIT (SEQ ID NO: 152); an amino acid sequence motif 10 having at least 90% identity to an amino acid sequence of the formula [WPY][DTN][HNV][VI][AG]R[VI][RW]F[SQ]TS[RL][GL]R[TI]FE[YF]G[SM][ST][RV][EQ]P[ST]G[QKR][WV][FIT][TE][VA]NVGSGVCVG[VM] (SEQ ID NO: 156); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 27 having at least 90% identity to an amino acid sequence of the formula T[TFPS]IL[EQS][EQH]LP[DA] (SEQ ID NO: 172); an amino acid sequence motif 7 having at least 90% identity to an amino acid sequence of the formula [NT]D[SK]NN[AD][GDS]S[IE][PS][KL]NW[TV][FL][SA]GSR[TQ]VT[ITV]SS[ST]W

[STR][LT]T (SEQ ID NO: 153); an amino acid sequence motif 21 having at least 90% identity to an amino acid sequence of the formula HL[TV][GA][NRS][AND]I[STL][IVL][ND][VILM][DTS]LGI[ND][TA]P[TK][VI]V[PA] (SEQ ID NO: 167); an amino acid sequence motif 18 having at least 90% identity to an amino acid sequence of the formula G[TLP][AE]GAST[NTA]F[GQH]W[EQ]T[VA]R[TA]FPS[TIS]NA (SEQ ID NO: 164); an amino acid sequence motif 9 having at least 90% identity to an amino acid sequence of the formula [IMV][QE]G[ST]I[AS][ND]L[TI]V[SRT]T[NAD][EA]YSVW[CG]H[IV]SDT[LVI]APAQ[SL][LI][PI][K S][HR][RASV]A (SEQ ID NO: 155v) an amino acid sequence motif 14 having at least 90% identity to an amino acid sequence of the formula [LW][VI]GEG[RS]I[TD][AN]L[PQ]CSA[NR]IQV[FIL]T[SD][GAS][GAD][NGY][NDG][LF]PF[AG][TS]F[ST]FPV[RGQ][LSV][LF]Y[DNS][GA][GR]AHS[DNQT]VQ[VI][LI] (SEQ ID NO: 160).

In some embodiments the nucleic acid molecule encodes a PtIP-65 polypeptide, comprising an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); and at least one amino acid sequence motif selected from: i) an amino acid sequence motif 17 having at least 90% identity to an amino acid sequence of the formula D[GE][VA][QEA][KQR][TL]FGDP[SH][RD]P[APS]GE (SEQ ID NO: 163); ii) an amino acid sequence motif 4 having at least 90% identity to an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); iii) an amino acid sequence motif 7 having at least 90% identity to an amino acid sequence of the formula [NT]D[SK]NN[AD][GDS]S[IE][PS][KL]NW[TV][FL][SA]GSR[TQ]V[T][ITV]SS[ST]W[STR][LT]T (SEQ ID NO: 153); and iv) an amino acid sequence motif 15 having at least 90% identity to an amino acid sequence of the formula [LF][ED][QT][AQ]G[IVST]P[VITQ][TA]L[DK] (SEQ ID NO: 161).

In some embodiments the nucleic acid molecule encodes a PtIP-65 polypeptide, comprising sequentially from the N-terminus to the C-terminus of the PtIP-65 polypeptide: an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 6 having at least 90% identity to an amino acid sequence of the formula R[GL][SE]YSE[FY]TFA[DET]GERIT (SEQ ID NO: 152); an amino acid sequence motif 17 having at least 90% identity to an amino acid sequence of the formula D[GE][VA][QEA][KQR][TL]FGDP[SH][RD]P[APS]GE (SEQ ID NO: 163); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 16 having at least 90% identity to an amino acid sequence of the formula [AVS]SG[ILV][CW][VA]G[IVLF][TILMR] (SEQ ID NO: 162); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 15 having at least 90% identity to an amino acid sequence of the formula [LF][ED][QT][AQ]G[IVST]P[VITQ][TA]L[DK] (SEQ ID NO: 161); an amino acid sequence motif 7 having at least 90% identity to an amino acid sequence of the formula [NT]D[SK]NN[AD][GDS]S[IE][PS][KL]NW[TV][FL][SA]GSR[TQ]V[T][ITV]SS[ST]W[STR][LT]T (SEQ ID NO: 153); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); and an amino acid sequence motif 4 having at least 90% identity to an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); and at least one amino acid sequence motif selected from: i) an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); and ii) an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I[NSQT]V[QSNT]YPTL (SEQ ID NO: 175).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 3 as represented by an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175); and at least one amino acid sequence motif selected from: i) an amino acid sequence motif 1 as represented by an amino acid sequence of the formula RLSLWGNGAGTR[SAT]G[WAGYF]I [RYKWF]F[YERDKWF]T[TNSQ][TQNS][GNQ][GRK] [SR TK]F[FDE][FPH][GKR]M[TYSWF]SWG[LKRIV] [KQRN]TEYP[IVQLN]DV (SEQ ID NO: 173); ii) an amino acid sequence motif 5 as represented by an amino acid sequence of the formula [GQN][ILFV][EITDLVS][AT-VSIL][HTS][AST]S[VIL][TS]V[QESNDT]A[GRK]IP [AST][VLI]AEV[S NTQ]G[EVDIL][FVIL]GW[SEQTDN] [VIL]S[VAIL][ST] (SEQ ID NO: 177); iii) an amino acid sequence motif 12 as represented by an amino acid sequence of the formula [LMIV][AVYILF][QLNIV][TVSIL][PILV] [VGIL][YTWS][VLI]IGGQGG[SNTQ][AQSNT] (SEQ ID NO: 184); and iv) an amino acid sequence motif 16 as represented by an amino acid sequence of the formula [AVSILT]SG[ILV][CWY][VAIL]G[IVLF][TILMRSVK] (SEQ ID NO: 188).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 3 as represented by an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YE-RDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 5 as represented by an amino acid sequence of the formula [GQN][ILFV][EITDLVS][ATVSIL][HTS][AST]S [VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL] [YTWS][VLI]IGGQGG[SNTQ][AQSNT] (SEQ ID NO: 184); an amino acid sequence motif 16 as represented by an amino acid sequence of the formula [AVSILT]SG[ILV] [CWY][VAIL]G[IVLF][TILMRSVK] (SEQ ID NO: 188); an amino acid sequence motif 11 as represented by an amino acid sequence of the formula K[ST]F[NTQS]L[QGLNIV] N[TAS]A[DHNQE][QHN][DE]D[PQN]SST[EQND] [QKNR]LAW[EQN D]LADEP[SRTK]FDNV[SFTWY] [HLIV][ST]W[SITLV]LSN (SEQ ID NO: 183); an amino acid sequence motif 17 as represented by an amino acid sequence of the formula D[GED][VAIL][QEAND][KQRN] [TLSIV]FGDP[SHT][RDKE]P[APST]GE (SEQ ID NO: 189); an amino acid sequence motif 20 as represented by an amino acid sequence of the formula DT[QEND] SSSLSSSSL[LSIVT]LPWSR[NSQT]GSLLPS [EKQDNR]S[LFIV] (SEQ ID NO: 192); an amino acid sequence motif 24 as represented by an amino acid sequence of the formula [AQN][RVKIL][VTILS]TT[ST][GH][GST] [TRSK]FSF[SPT]GL[QHKNR]G[AFLRIVK][FY]TG[QE DN]S[HYW][VAIL][IPLV][ADE][IVL]T[TAS]Q (SEQ ID NO: 196); and an amino acid sequence motif 26 as represented by an amino acid sequence of the formula L[SVTIL] AL[PTS][YFRWK][RDGQKEN]G[NDITQELVS][VALI] [NSRQTK][GDNEQ]L[PFRSKT]F[NDETQS] (SEQ ID NO: 197).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 3 as represented by an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YE-RDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 5 as represented by an amino acid sequence of the formula [GQN][ILFV][EITDLVS][ATVSIL][HTS][AST]S [VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL] [YTWS][VLI]IGGQGG[SNTQ][AQSNT] (SEQ ID NO: 184); an amino acid sequence motif 16 as represented by an amino acid sequence of the formula [AVSILT]SG[ILV] [CWY][VAIL]G[IVLF][TILMRSVK] (SEQ ID NO: 188); an amino acid sequence motif 11 as represented by an amino acid sequence of the formula K[ST]F[NTQS]L[QGLNIV] N[TAS]A[DHNQE][QHN][DE]D[PQN]SST[EQND] [QKNR]LAW[EQN D]LADEP[SRTK]FDNV[SFTWY] [HLIV][ST]W[SITLV]LSN (SEQ ID NO: 183); an amino acid sequence motif 17 as represented by an amino acid sequence of the formula D[GED][VAIL][QEAND][KQRN] [TLSIV]FGDP[SHT][RDKE]P[APST]GE (SEQ ID NO: 189); an amino acid sequence motif 20 as represented by an amino acid sequence of the formula DT[QEND] SSSLSSSSL[LSIVT]LPWSR[NSQT]GSLLPS [EKQDNR]S[LFIV] (SEQ ID NO: 192); an amino acid sequence motif 24 as represented by an amino acid sequence of the formula [AQN][RVKIL][VTILS]TT[ST][GH][GST] [TRSK]FSF[SPT]GL[QHKNR]G[AFLRIVK][FY]TG[QE DN]S[HYW][VAIL][IPLV][ADE][IVL]T[TAS]Q (SEQ ID NO: 196); and an amino acid sequence motif 26 as represented by an amino acid sequence of the formula L[SVTIL] AL[PTS][YFRWK][RDGQKEN]G[NDITQELVS][VALI] [NSRQTK][GDNEQ]L[PFRSKT]F[NDETQS] (SEQ ID NO: 197).

In some embodiments the nucleic acid molecule encodes a PtIP-65 polypeptide, comprising, sequentially from the N-terminus to the C-terminus of the PtIP-65 polypeptide: at least one amino acid sequence motif selected from: an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 6 as represented by an amino acid sequence of the formula R[GLIV][SETD]YSE[FYW]TFA[DETS]GERIT (SEQ ID NO: 178); an amino acid sequence motif 17 as represented by an amino acid sequence of the formula D[GED][VAIL] [QEAND][KQRN][TLSIV]FGDP[SHT][RDKE]P[APST] GE (SEQ ID NO: 189); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 16 as represented by an amino acid sequence of the formula [AVSILT]SG[ILV][CWY][VAIL]G[IVLF] [TILMRSVK] (SEQ ID NO: 188); an amino acid sequence motif 3 as represented by an amino acid sequence of the formula GRA[NSQT][SVTIL]D[IVL][DNQE][SAT]LG [FVIL][VMLI]FLR[PTS]I[QAN]S[AVCSILT]R[LMIV]I [NSQT]V[QSNT]YPTL (SEQ ID NO: 175); an amino acid sequence motif 11 as represented by an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV] LSN (SEQ ID NO: 183); an amino acid sequence motif 5 as represented by an amino acid sequence of the formula [GQN][ILFV][EITDLVS][ATVSIL][HTS][AST]S[VIL] [TS]V[QESNDT]A[GRK]IP[AST][VLI]AEV[S NTQ]G [EVDIL][FVIL]GW[SEQTDN][VIL]S[VAIL][ST] (SEQ ID NO: 177); an amino acid sequence motif 20 as represented by an amino acid sequence of the formula DT[QEND]SSSLSSSSSL[LSIVT]LPWSR[NSQT] GSLLPS[EKQDNR]S[LFIV] (SEQ ID NO: 192); an amino acid sequence motif 26 as represented by an amino acid sequence of the formula L[SVTIL]AL[PTS][YFRWK] [RDGQKEN]G[NDITQELVS][VALI][NSRQTK][GDNEQ]L[PFRSKT]F[NDETQS] (SEQ ID NO: 197) and an amino acid sequence motif 24 as represented by an amino acid sequence of the formula [AQN][RVKIL][VTILS]TT [ST][GH][GST][TRSK]FSF[SPT]GL[QHKNR]G[AFLRIVK][FY]TG[QE DN]S[HYW][VAIL][IPLV][ADE] [IVL]T[TAS]Q (SEQ ID NO: 196).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 3 as represented by an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 5 as represented by an amino acid sequence of the formula [GQN][ILFV][EITDLVS][ATVSIL][HTS][AST]S [VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL] [YTWS][VLI]IGGQGG[SNTQ][AQSNT] (SEQ ID NO: 184); an amino acid sequence motif 16 as represented by an amino acid sequence of the formula [AVSILT]SG[ILV] [CWY][VAIL]G[IVLF][TILMRSVK] (SEQ ID NO: 188); and at least one amino acid sequence motif selected from: i) an amino acid sequence motif 8 as represented by an amino acid sequence of the formula [QGN][EVD][GKR]D[HQN] [NSQT]VQP[NDQE]KE[VAIL][EKQDRN]E[CRSKT] [KTSR][LVI]LF[AITLVS]E (SEQ ID NO: 180); ii) an amino acid sequence motif 13 as represented by an amino acid sequence of the formula GVDYTSVDI[TVIL][NSQT] [TQSN]GTRSK[ADE] (SEQ ID NO: 185); iii) an amino acid sequence motif 19 as represented by an amino acid sequence of the formula [TS]G[DSTNQE][DS][TSNQ]P [AHYRITKLVS][TVLSI][FYC]G[TS][APVIL] (SEQ ID NO: 191); iv) an amino acid sequence motif 22 as represented by an amino acid sequence of the formula [KLSRIVT][DKNERQ][EHQND]VEV[EQDN]A[TVSIL] [DE]QQ (SEQ ID NO: 194); and v) an amino acid sequence motif 23 as represented by an amino acid sequence of the formula Y[TAS][ST]TQEESRTLT (SEQ ID NO: 195).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 3 as represented by an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 5 as represented by an amino acid sequence of the formula [GQN][ILFV][EITDLVS][ATVSIL][HTS][AST]S [VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL] [YTWS][VLI]IGGQGG[SNTQ][AQSNT] (SEQ ID NO: 184); an amino acid sequence motif 16 as represented by an amino acid sequence of the formula [AVSILT]SG[ILV] [CWY][VAIL]G[IVLF][TILMRSVK] (SEQ ID NO: 188); an amino acid sequence motif 8 as represented by an amino acid sequence of the formula [QGN][EVD][GKR]D[HQN] [NSQT]VQP[NDQE]KE[VAIL][EKQDRN]E[CRSKT] [KTSR][LVI]LF[AITLVS]E (SEQ ID NO: 180); an amino acid sequence motif 13 as represented by an amino acid sequence of the formula GVDYTSVDI[TVIL][NSQT][TQSN]GTRSK[ADE] (SEQ ID NO: 185); an amino acid sequence motif 19 as represented by an amino acid sequence of the formula [TS]G[DSTNQE][DS][TSNQ]P[AHYRIT-KLVS][TVLSI][FYC]G[TS][APVIL] (SEQ ID NO: 191); an amino acid sequence motif 22 as represented by an amino acid sequence of the formula [KLSRIVT][DKNERQ][EHQND]VEV[EQDN]A[TVSIL][DE]QQ (SEQ ID NO: 194); an amino acid sequence motif 23 as represented by an amino acid sequence of the formula Y[TAS][ST]TQEES-RTLT (SEQ ID NO: 195); and at least one amino acid sequence motif selected from: i) an amino acid sequence motif 4 as represented by an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); ii) an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); and iii) an amino acid sequence motif as represented by an amino acid sequence of the formula [LFIV][ED][QTNS][AQ]GI[IVSTL]P[VITQLSN][TAS]L[DKER] (SEQ ID NO: 187).

In some embodiments the nucleic acid molecule encodes a PtIP-65 polypeptide, comprising, sequentially from the N-terminus to the C-terminus of the PtIP-65 polypeptide: at least one amino acid sequence motif selected from: an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 as represented by an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 as represented by an amino acid sequence of the formula R[GLIV][SETD]YSE[FYW]TFA[DETS]GERIT (SEQ ID NO: 178); an amino acid sequence motif selected from: an amino acid sequence motif 1 as represented by an amino acid sequence of the formula RLSLWGNGAGTR[SAT]G[WAGYF]I[RYKWF]F[YE-RDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 as represented by an amino acid sequence of the formula [AVSILT]SG[ILV][CWY][VAIL]G[IVLF][TILMRSVK] (SEQ ID NO: 188); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I[NSQT]V[QSNT]YPTL (SEQ ID NO: 175); an amino acid sequence motif 15 as represented by an amino acid sequence of the formula [LFIV][ED][QTNS][AQ]GI[IVSTL]P[VITQLSN][TAS]L[DKER] (SEQ ID NO: 187); an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177) an amino acid sequence motif 23 as represented by an amino acid sequence of the formula Y[TAS][ST]TQEES-RTLT (SEQ ID NO: 195); an amino acid sequence motif 4 as represented by an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); an amino acid sequence motif 13 as represented by an amino acid sequence of the formula GVDYTSVDI[TVIL][NSQT][TQSN]GTRSK[ADE] (SEQ ID NO: 185); an amino acid sequence motif 22 as represented by an amino acid sequence of the formula [KLSRIVT][DKNERQ][EHQND]VEV[EQDN]A[TVSIL][DE]QQ (SEQ ID NO: 194); and an amino acid sequence motif 8 as represented by an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180).

In some embodiments the nucleic acid molecule encodes a PtIP-65 polypeptide, comprising, sequentially from the N-terminus to the C-terminus of the PtIP-65 polypeptide: at least one amino acid sequence motif selected from: an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 as represented by an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 as represented by an amino acid sequence of the formula R[GLIV][SETD]YSE[FYW]TFA[DETS]GERIT (SEQ ID NO: 178); an amino acid sequence motif 10 as represented by an amino acid sequence of the formula [WPYF][DTNQES][HNVQ-IL][VIL][AG]R[VIL][RWKYH]F[SQTN]TS[RLKIV][GLIV]R[TISLV]FE[YFW]G[SMT][ST][RV][EQND]P[ST]G[QKRN][WVYIL][FITLVS][TESD][VAIL]NVGSGVCVG[V MIL] (SEQ ID NO: 182); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 27 as represented by an amino acid sequence of the formula T[TFPS]IL[EQSDNT][EQHDN]LP[DAE] (SEQ ID NO: 198); an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 21 as represented by an amino acid sequence of the formula HL[TVSIL][GA][NRSQKT][ANDQE]I[STLIV][IVL][NDQE][VILM][DTSE]LGI[ND][TAS]P[TKSR][VIL]V[PA] (SEQ ID NO: 193); an amino acid sequence motif 18 as represented by an amino acid sequence of the formula G[TLPSIV][AED]GAST[NTAQS]F[GQHN]W[EQND]T[VAIL]R[TAS]FPS[TISLV]NA (SEQ ID NO: 190); an amino acid sequence motif 9 as represented by an amino acid sequence of the formula [IMVL][QEND]G[ST]I[AST][NDQE]L[TISLV]V[SRTK]T[NADQE][EAD]YSVW[CG]H[IVL]SDT[L VI]APAQ[SLTIV][LIV][PIVL][KSRT][HRK][RASVK- TIL]A (SEQ ID NO: 181); an amino acid sequence motif 14 as represented by an amino acid sequence of the formula [LWIVF][VIL]GEG[RSKT]I[TDSE][ANQ]L[PQN]CSA [NRQK]IQV[FILV]T[SDTE][GAST][GADE][NGYQ] [NDGQE][LFIV]PF[AG][TS]F[ST]FPV[RGQKN][LS-VIT][LFIV]Y[DNSQET][GA][GRK]A HS[DNQTES]VQ [VIL][LIV] (SEQ ID NO: 186).

In some embodiments the nucleic acid molecule encodes a PtIP-65 polypeptide, comprising an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 3 as represented by an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YE-RDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 5 as represented by an amino acid sequence of the formula [GQN][ILFV][EITDLVS][ATVSIL][HTS][AST]S [VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL] [YTWS][VLI]IGGQGG[SNTQ][AQSNT] (SEQ ID NO: 184); an amino acid sequence motif 16 as represented by an amino acid sequence of the formula [AVSILT]SG[ILV] [CWY][VAIL]G[IVLF][TILMRSVK] (SEQ ID NO: 188); and at least one amino acid sequence motif selected from: i) an amino acid sequence motif 17 as represented by an amino acid sequence of the formula D[GED][VAIL][QEAND] [KQRN][TLSIV]FGDP[SHT][RDKE]P[APST]GE (SEQ ID NO: 189); ii) an amino acid sequence motif 4 as represented by an amino acid sequence of the formula W[NGQ][QVNIL]SGTL[ESDT][PA]G[QEND][WSYT]I [SHT][LIV][QKNR]A[TLSIV]TR[RK]G[TLS IV]I[TS] [LVI]P[YFW]Q[GA][TS][MILV][EQND][IVL]TL[QKLN-RIV][SNTQ]G[TDSE][VIL]F[QRNK]Y[PA][ILV][SKTR] [SGT][MQN]Y (SEQ ID NO: 176); iii) an amino acid sequence motif 7 as represented by an amino acid sequence of the formula [NTQS]D[SKTR]NN[ADE][GDSET]S [IELVD][PST][KLRIV]NW[TVSIL][FLIV][SAT]GSR [TQSN]VT[ITVLS]SS[ST]W[STRK][LTIVS]T (SEQ ID NO: 179); and iv) an amino acid sequence motif 15 as represented by an amino acid sequence of the formula [LFIV][ED][QTNS][AQ]GI[IVSTL]P[VITQLSN][TAS]L [DKER] (SEQ ID NO: 187).

In some embodiments the nucleic acid molecule encodes a PtIP-65 polypeptide comprising, sequentially from the N-terminus to the C-terminus of the PtIP-65 polypeptide: at least one amino acid sequence motif selected from: an amino acid sequence motif 12 as represented by an amino acid sequence of the formula [LMIV][AVYILF][QLNIV][TV-SIL][PILV][VGIL][YTWS][VLI]IGGQGG[SNTQ] [AQSNT] (SEQ ID NO: 184); an amino acid sequence motif 2 as represented by an amino acid sequence of the formula F[STRK]Y[DYEWF][GQN][GSETD][TRKS][DNQE]G [RK]V[LMIV][QTRNSK][RK]I[GRK]V[WY][ARK][GA] [ETDS][SWTYF][RQKN][ILV][KR][AG]I[RESKDT]VW [LMIV] (SEQ ID NO: 174); an amino acid sequence motif 6 as represented by an amino acid sequence of the formula R[GLIV][SETD]YSE[FYW]TFA[DETS]GERIT (SEQ ID NO: 178); an amino acid sequence motif 17 as represented by an amino acid sequence of the formula D[GED][VAIL] [QEAND][KQRN][TLSIV]FGDP[SHT][RDKE]P[APST] GE (SEQ ID NO: 189); an amino acid sequence motif selected from: an amino acid sequence motif 1 as represented by an amino acid sequence of the formula RLSLWGNGAGTR[SAT]G[WAGYF]I[RYKWF]F[YE-RDKWF]T[TNSQ][TQNS][GNQ][GRK][SR TK]F[FDE] [FPH][GKR]M[TYSWF]SWG[LKRIV][KQRN]TEYP [IVQLN]DV (SEQ ID NO: 173); an amino acid sequence motif 16 as represented by an amino acid sequence of the formula [AVSILT]SG[ILV][CWY][VAIL]G[IVLF] [TILMRSVK] (SEQ ID NO: 188); an amino acid sequence motif 3 as represented by an amino acid sequence of the formula GRA[NSQT][SVTIL]D[IVL][DNQE][SAT]LG [FVIL][VMLI]FLR[PTS]I[QAN]S[AVCSILT]R[LMIV]I [NSQT]V[QSNT]YPTL (SEQ ID NO: 175); an amino acid sequence motif 15 as represented by an amino acid sequence of the formula [LFIV][ED][QTNS][AQ]GI[IVSTL]P [VITQLSN][TAS]L[DKER] (SEQ ID NO: 187); an amino acid sequence motif 7 as represented by an amino acid sequence of the formula [NTQS]D[SKTR]NN[ADE][GD-SET]S[IELVD][PST][KLRIV]NW[TVSIL][FLIV][SAT] GSR[TQSN]VT[ITVLS]SS[ST]W[STRK][LTIVS]T (SEQ ID NO: 179); an amino acid sequence motif 5 as represented by an amino acid sequence of the formula [GQN][ILFV] [EITDLVS][ATVSIL][HTS][AST]S[VIL][TS]V [QESNDT]A[GRK]IP[AST][VLI]AEV[S NTQ]G[EVDIL] [FVIL]GW[SEQTDN][VIL]S[VAIL][ST] (SEQ ID NO: 177); and an amino acid sequence motif 4 as represented by an amino acid sequence of the formula W[NGQ][QVNIL] SGTL[ESDT][PA]G[QEND][WSYT]I[SHT][LIV][QKNR] A[TLSIV]TR[RK]G[TLS IV]I[TS][LVI]P[YFW]Q[GA] [TS][MILV][EQND][IVL]TL[QKLNRIV][SNTQ]G [TDSE][VIL]F[QRNK]Y[PA][ILV][SKTR][SGT][MQN]Y (SEQ ID NO: 176).

In some embodiments the nucleic acid molecule encodes a PtIP-65 polypeptide comprising, an amino acid sequence motif 6 having at least 90% identity to an amino acid sequence of the formula R[GLIV][SETD]YSE[FYW]TFA [DETS]GERIT (SEQ ID NO: 178).

In some embodiments the nucleic acid molecule encodes a PtIP-65 polypeptide comprising, an amino acid sequence motif 6 having at least 90% identity to an amino acid sequence of the formula R[GLIV][SETD]YSE[FYW]TFA [DETS]GERIT (SEQ ID NO: 178); and at least one amino acid sequence motif selected from: i) an amino acid sequence motif 2 having at least 90% identity to an amino acid sequence of the formula F[STRK]Y[DYEWF][GQN] [GSETD][TRKS][DNQE]G[RK]V[LMIV][QTRNSK][RK] I[GRK]V[WY][ARK][GA][ETDS][SWTYF][RQKN] [ILV][KR][AG]I[RESKDT]VW[LMIV] (SEQ ID NO: 174); and ii) an amino acid sequence motif 3 having at least 90% identity to an amino acid sequence of the formula GRA[NSQT][SVTIL]D[IVL][DNQE][SAT]LG[FVIL] [VMLI]FLR[PTS]I[QAN]S[AVCSILT]R[LMIV]I [NSQT] V[QSNT]YPTL (SEQ ID NO: 175).

In some embodiments the nucleic acid molecule encodes a PtIP-65 polypeptide, comprising an amino acid sequence motif 6 having at least 90% identity to an amino acid sequence of the formula R[GLIV][SETD]YSE[FYW]TFA [DETS]GERIT (SEQ ID NO: 178); an amino acid sequence motif 2 having at least 90% identity to an amino acid sequence of the formula F[STRK]Y[DYEWF][GQN][G-SETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][S-VTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); and at least one amino acid sequence motif selected from: i) an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); ii) an amino acid sequence motif 5 having at least 90% identity to an amino acid sequence of the formula [GQN][ILFV][EITDLVS][AT-VSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); iii) an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); and iv) an amino acid sequence motif 16 having at least 90% identity to an amino acid sequence of the formula [AVSILT]SG[ILV][CWY][VAIL]G[IVLF][TILMRSVK] (SEQ ID NO: 188).

In some embodiments the nucleic acid molecule encodes a PtIP-65 polypeptide, comprising an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][G-SETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][S-VTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 11 having at least 90% identity to an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); ii) an amino acid sequence motif 17 having at least 90% identity to an amino acid sequence of the formula D[GED][VAIL][QE-AND][KQRN][TLSIV]FGDP[SHT][RDKE]P[APST]GE (SEQ ID NO: 189); iii) an amino acid sequence motif 20 having at least 90% identity to an amino acid sequence of the formula DT[QEND]SSSLSSSSSL[LSIVT]LPWSR[NSQT]GSLLPS[EKQDNR]S[LFIV](SEQ ID NO: 192); iv) an amino acid sequence motif 24 having at least 90% identity to an amino acid sequence of the formula [AQN][RVKIL][VTILS]TT[ST][GH][GST][TRSK]FSF[SPT]GL[QH-KNR]G[AFLRIVK][FY]TG[QE DN]S[HYW][VAIL][IPL-V][ADE][IVL]T[TAS]Q (SEQ ID NO: 196); and v) an amino acid sequence motif 26 having at least 90% identity to an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197).

In some embodiments the nucleic acid molecule encodes a PtIP-65 polypeptide, comprising an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][G-SETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][S-VTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 11 having at least 90% identity to an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); an amino acid sequence motif 17 having at least 90% identity to an amino acid sequence of the formula D[GED][VAIL][QE-AND][KQRN][TLSIV]FGDP[SHT][RDKE]P[APST]GE (SEQ ID NO: 189); an amino acid sequence motif 20 having at least 90% identity to an amino acid sequence of the formula DT[QEND]SSSLSSSSSL[LSIVT]LPWSR[NSQT]GSLLPS[EKQDNR]S[LFIV] (SEQ ID NO: 192); an amino acid sequence motif 24 having at least 90% identity to an amino acid sequence of the formula [AQN][RVKIL][VTIL-S]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196); and an amino acid sequence motif 26 having at least 90% identity to an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197).

In some embodiments the nucleic acid molecule encodes a PtIP-65 polypeptide, comprising, sequentially from the N-terminus to the C-terminus of the PtIP-65 polypeptide: an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT](SEQ ID NO: 184); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 6 having at least 90% identity to an amino acid sequence of the formula R[GLIV][SETD]YSE[FYW]TFA[DETS]GERIT (SEQ ID NO: 178); an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 11 having at least 90% identity to an amino acid sequence of the formula K[ST]F[NTQS]L[QGLNIV]N[TAS]A[DHNQE][QHN][DE]D[PQN]SST[EQND][QKNR]LAW[EQND]LADEP[SRTK]FDNV[SFTWY][HLIV][ST]W[SITLV]LSN (SEQ ID NO: 183); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 20 having at least 90% identity to an amino acid sequence of the formula DT[QEND]SSSLSSSSSL[LSIVT]LPWSR[NSQT]GSLLPS[EKQDNR]S[LFIV] (SEQ ID NO: 192); an amino acid sequence motif 26 having at least 90% identity to an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197) and an amino acid sequence motif 24 having at least 90% identity to an amino acid sequence of the formula [AQN][RVKIL][VTILS]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196).

In some embodiments the nucleic acid molecule encodes a PtIP-65 polypeptide, comprising an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 8 having at least 90% identity to an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180); ii) an amino acid sequence motif 13 having at least 90% identity to an amino acid sequence of the formula GVDYTSVDI[TVIL][NSQT][TQSN]GTRSK[ADE] (SEQ ID NO: 185); iii) an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); iv) an amino acid sequence motif 22 having at least 90% identity to an amino acid sequence of the formula [KLSRIVT][DKNERQ][EHQND]VEV[EQDN]A[TVSIL][DE]QQ (SEQ ID NO: 194); and v) an amino acid sequence motif 23 having at least 90% identity to an amino acid sequence of the formula Y[TAS][ST]TQEESRTLT (SEQ ID NO: 195).

In some embodiments the nucleic acid molecule encodes a PtIP-65 polypeptide, comprising an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATV- SIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TV-SIL][PILV][VGIL][YTWS][VLI]IGGQGG[SNTQ][AQSNT] (SEQ ID NO: 184); an amino acid sequence motif 16 having at least 90% identity to an amino acid sequence [AVSILT]SG[ILV][CWY][VAIL]G[IVLF][TILMRSVK] (SEQ ID NO: 188); an amino acid sequence motif 8 having at least 90% identity to an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180); an amino acid sequence motif 13 having at least 90% identity to an amino acid sequence of the formula GVDYTSVDI[TVIL][NSQT][TQSN]GTRSK[ADE](SEQ ID NO: 185); an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 22 having at least 90% identity to an amino acid sequence of the formula [KLSRIVT][DKNERQ][EHQND]VEV[EQDN]A[TVSIL][DE]QQ (SEQ ID NO: 194); an amino acid sequence motif 23 having at least 90% identity to an amino acid sequence of the formula Y[TAS][ST]TQEESRTLT (SEQ ID NO: 195); and at least one amino acid sequence motif selected from: i) an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); ii) an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); and iii) an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187).

In some embodiments the nucleic acid molecule encodes a PtIP-65 polypeptide, comprising, sequentially from the N-terminus to the C-terminus of the PtIP-65 polypeptide: an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT](SEQ ID NO: 184); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 having at least 90% identity to an amino acid sequence of the formula R[GLIV][SETD]YSE[FYW]TFA[DETS]GERIT (SEQ ID NO: 178); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187); an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 23 having at least 90% identity to an amino acid sequence of the formula Y[TAS][ST]TQEESRTLT (SEQ ID NO: 195); an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); an amino acid sequence motif 13 having at least 90% identity to an amino acid sequence of the formula GVDYTSVDI[TVIL][NSQT][TQSN]GTRSK[ADE] (SEQ ID NO: 185); an amino acid sequence motif 22 having at least 90% identity to an amino acid sequence of the formula [KLSRIVT][DKNERQ][EHQND]VEV[EQDN]A[TVSIL][DE]QQ (SEQ ID NO: 194); and an amino acid sequence motif 8 having at least 90% identity to an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180).

In some embodiments the nucleic acid molecule encodes a PtIP-65 polypeptide, comprising, sequentially from the N-terminus to the C-terminus of the PtIP-65 polypeptide: an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 having at least 90% identity to an amino acid sequence of the formula R[GLIV][SETD]YSE[FYW]TFA[DETS]GERIT (SEQ ID NO: 178); an amino acid sequence motif 10 having at least 90% identity to an amino acid sequence of the formula [WPYF][DTNQES][HNVQIL][VIL][AG]R[VIL][RWKYH]F[SQTN]TS[RLKIV][GLIV]R[TISLV]FE[YFW]G[SMT][ST][RV][EQND]P[ST]G[QKRN][WVYIL][FITLVS][TESD][VAIL]NVGSGVCVG[V MIL] (SEQ ID NO: 182); an amino acid sequence motif 3 having at least 90% identity to an amino acid sequence of GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 27 having at least 90% identity to an amino acid sequence of the formula T[TFPS]

IL[EQSDNT][EQHDN]LP[DAE] (SEQ ID NO: 198); an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 21 having at least 90% identity to an amino acid sequence of the formula HL[TVSIL][GA][NRSQKT][ANDQE]I[STLIV][IVL][NDQE][VILM][DTSE]LGI [ND][TAS]P[TKSR][VIL]V[PA] (SEQ ID NO: 193); an amino acid sequence motif 18 having at least 90% identity to an amino acid sequence of the formula G[TLPSIV][AED]GAST[NTAQS]F[GQHN]W[EQND]T[VAIL]R[TAS]FPS[TISLV]NA (SEQ ID NO: 190); an amino acid sequence motif 9 having at least 90% identity to an amino acid sequence of the formula [IMVL][QEND]G[ST]I[AST][NDQE]L[TISLV]V[SRTK]T[NADQE][EAD]YSVW[CG]H[IVL]SDT[L VI]APAQ[SLTIV][LIV][PIVL][KSRT][HRK][RASVKTIL]A (SEQ ID NO: 181); an amino acid sequence motif 14 having at least 90% identity to an amino acid sequence of the formula [LWIVF][VIL]GEG[RSKT]I[TDSE][ANQ]L[PQN]CSA[NRQK]IQV[FILV]T[SDTE][GAST][GADE][NGYQ][NDGQE][LFIV]PF[AG][TS]F[ST]FPV[RGQKN][LSVIT][LFIV]Y[DNSQET][GA][GRK]A HS[DNQTES]VQ[VIL][LIV] (SEQ ID NO: 186).

In some embodiments the nucleic acid molecule encodes a PtIP-65 polypeptide, comprising an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); ii) an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); iii) an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); and iv) an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187). In some embodiments the nucleic acid molecule encodes a PtIP-65 polypeptide, comprising, sequentially from the N-terminus to the C-terminus of the PtIP-65 polypeptide: an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 6 having at least 90% identity to an amino acid sequence of the formula R[GLIV][SETD]YSE[FYW]TFA[DETS]GERIT (SEQ ID NO: 178); an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187); an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); and an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176).

In some embodiments the nucleic acid molecule encodes a PtIP-65 polypeptide that is about 300 to 400 amino acids in length having a consensus secondary structure comprising 13 to 17 segments of predominately beta strand structure separated by coil regions.

In some embodiments the nucleic acid molecule encodes a PtIP-65 polypeptide, comprising, sequentially from the N-terminus to the C-terminus; i) a beta strand-1 (β1) of between about 3 amino acids and about 9 amino acids in length, ii) a coil of between about 17 amino acids and about 21 amino acids in length; iii) a beta strand-2 (β2) of between about 7 amino acids and about 9 amino acids in length, iv) a coil of between about 3 amino acids and about 4 amino acids in length; v) a beta strand-3 (β3) of between about 9 amino acids and about 10 amino acids in length, vi) a coil of between about 2 amino acids and about 5 amino acids in length; vii) a beta strand-4 (β4) of between about 3 amino acids and about 8 amino acids in length, viii) a coil of between about 7 amino acids and about 13 amino acids in length; ix) a beta strand-5 (β5) of between about 3 amino acids and about 5 amino acids in length, x) a coil of between about 4 amino acids and about 5 amino acids in length; xi) a beta strand-6 (β6) of between about 8 amino acids and about 12 amino acids in length, xii) a coil of between about 5 amino acids and about 12 amino acids in length; xiii) a beta strand-7 (β7) of between about 9 amino acids and about 13 amino acids in length, xiv) a coil of about 4 amino acids in length; xv) a beta strand-8 (β1) of between about 3 amino acids and about 7 amino acids in length, xvi) a coil of between about 5 amino acids and about 9 amino acids in length; xvii) a beta strand-9 (β9) of between about 3 amino acids and about 5 amino acids in length, xviii) a coil of between about 3 amino acids and about 6 amino acids in length; ixx) a beta strand-10 (β10) of between about 7 amino acids and about 13 amino acids in length, xx) a coil of between about 3 amino acids and about 8 amino acids in length; xxi) a beta strand-11 (β11) of between about 5 amino acids and about 18 amino acids in length, xxii) a coil of between about 10 amino acids and about 22 amino acids in length; xxiii) a beta strand-12 (β12) of between about 7 amino acids and about 12 amino acids in length, xxiv) a coil of between about 5 amino acids and about 13 amino acids in length; xxv) a beta strand-13 (β13) of between about 60 amino acids and about 90 amino acids in length, xxvi) a coil of between about 4 amino acids and about 8 amino acids in length; xxvii) a beta strand-14 (β14) of between about 22 amino acids and about 30 amino acids in length, xxviii) a coil of between about 3 amino acids and about 8 amino acids in length; and xxix) a beta strand-15 (β15) of between about 22 amino acids and about 26 amino acids in length. As used herein, the term "about" when used in the context of the lower/upper limit of the length of a secondary structural element means the greater of −/+ an integer of up to −/+20% of the length of the secondary structural element or −/+1 amino acid. By means of example, a secondary structure element of between about 3 amino acids and about 23 amino acids in length means a secondary structure element of between 2 and 27 amino acids in length.

Also provided are nucleic acid molecules that encode transcription and/or translation products that are subsequently spliced to ultimately produce functional PtIP-50 polypeptides or PtIP-65 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate a PtIP-50 polypeptide or PtIP-65 polypeptide encoding sequence. An example of trans splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments the polynucleotides do not directly encode a full-length PtIP-50 polypeptide or PtIP-65 polypeptide, but rather encode a fragment or fragments of a PtIP-50 polypeptide or PtIP-65 polypeptide. These polynucleotides can be used to express a functional PtIP-50 polypeptide or PtIP-65 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding PtIP-50 polypeptides or PtIP-65 polypeptides are also encompassed by the embodiments. "Fragment" as used herein refers to a portion of the nucleic acid sequence encoding a PtIP-50 polypeptide or PtIP-65 polypeptide. A fragment of a nucleic acid sequence may encode a biologically active portion of a PtIP-50 polypeptide or PtIP-65 polypeptide or it may be a fragment that can be used as a hybridization probe or PCR primer using methods disclosed below. Nucleic acid molecules that are fragments of a nucleic acid sequence encoding a PtIP-50 polypeptide or PtIP-65 polypeptide comprise at least about 150, 180, 210, 240, 270, 300, 330 or 360, contiguous nucleotides or up to the number of nucleotides present in a full-length nucleic acid sequence encoding a PtIP-50 polypeptide or PtIP-65 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the PtIP-50 polypeptide/PtIP-65 polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of the full-length PtIP-50Aa polypeptide (SEQ ID NO: 71) in combination with PtIP-65Aa polypeptide (SEQ ID NO: 22). In some embodiments, the insecticidal activity is Lepidoptera activity. In one embodiment, the insecticidal activity is against a Coleopteran species. In some embodiments, the insecticidal activity is against one or more insect pests of the corn rootworm complex: western corn rootworm, *Diabrotica virgifera*; northern corn rootworm, *D. barberi*: Southern corn rootworm or spotted cucumber beetle; *Diabrotica undecimpunctata howardi*, and the Mexican corn rootworm, *D. virgifera zeae*. In one embodiment, the insecticidal activity is against a *Diabrotica* species.

In some embodiments a fragment of a nucleic acid sequence encoding a PtIP-50 polypeptide encoding a biologically active portion of a protein will encode at least about 15, 20, 30, 50, 75, 100, 125, contiguous amino acids or up to the total number of amino acids present in a full-length PtIP-50 polypeptide of the embodiments. In some embodiments, the fragment is an N-terminal and/or a C-terminal truncation of at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98 or variants thereof, e.g., by proteolysis, insertion of a start codon, deletion of the codons encoding the deleted amino acids with the concomitant insertion of a stop codon or by insertion of a stop codon in the coding sequence. In some embodiments, the fragments encompassed herein result from the removal of the N-terminal 1, 2, 3, 4, 5, 6, 7, 8, 9, 10, 11, 12, 13, 14, 15, 16, 17, 18, 19, 20, 21, 22, 23, 24, 25 or more amino acids from the N-terminus relative to SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98 or variants thereof, e.g., by proteolysis or by insertion of a start codon in the coding sequence. In some embodiments, the fragments encompassed herein result from the removal of the N-terminal 1, 2, 3, 4, 5, 6, 7, 8, 9, 10, 11, 12, 13, 14 amino acids relative to SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98 or variants thereof, e.g., by proteolysis or by insertion of a start codon in the coding sequence.

In some embodiments a PtIP-50 polypeptide is encoded by a nucleic acid sequence sufficiently homologous to the nucleic acid sequence of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by taking into account codon degeneracy, amino acid similarity, reading frame positioning, and the like. In some embodiments the sequence homology is against the full length sequence of the polynucleotide encoding a PtIP-50 polypeptide or against the full length sequence of a PtIP-50 polypeptide. In some embodiments the PtIP-50 polypeptide has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 43). The percent identity between two sequences can be determined using techniques similar to those described below, with or without allowing gaps. In calculating percent identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, (1990) *Proc. Natl. Acad. Sci. USA* 87:2264, modified as in Karlin and Altschul, (1993) *Proc. Natl. Acad. Sci. USA* 90:5873-5877. Such an algorithm is incorporated into the BLASTN and BLASTX programs of Altschul, et al., (1990) *J. Mol. Biol.* 215:403. BLAST nucleotide searches can be performed with the BLASTN program, score=100, wordlength=12, to obtain nucleic acid sequences homologous to pesticidal nucleic acid molecules of the embodiments. BLAST protein searches can be performed with the BLASTX program, score=50, wordlength=3, to obtain amino acid sequences homologous to pesticidal protein molecules of the embodiments. To obtain gapped alignments for comparison purposes, Gapped BLAST (in BLAST 2.0) can be utilized as described in Altschul, et al., (1997) *Nucleic Acids Res.* 25:3389. Alternatively, PSI-Blast can be used to perform an iterated search that detects distant relationships between molecules. See, Altschul, et al., (1997) supra. When utilizing BLAST, Gapped BLAST, and PSI-Blast programs, the default parameters of the respective programs (e.g., BLASTX and BLASTN) can be used. Alignment may also be performed manually by inspection.

Another non-limiting example of a mathematical algorithm utilized for the comparison of sequences is the ClustalW algorithm (Higgins, et al., (1994) *Nucleic Acids Res.*

22:4673-4680). ClustalW compares sequences and aligns the entirety of the amino acid or DNA sequence, and thus can provide data about the sequence conservation of the entire amino acid sequence. The ClustalW algorithm is used in several commercially available DNA/amino acid analysis software packages, such as the ALIGNX® module of the Vector NTI® Program Suite (Invitrogen Corporation, Carlsbad, Calif.). After alignment of amino acid sequences with ClustalW, the percent amino acid identity can be assessed. A non-limiting example of a software program useful for analysis of ClustalW alignments is GENEDOC™ GENEDOC™ (Karl Nicholas) allows assessment of amino acid (or DNA) similarity and identity between multiple proteins. Another non-limiting example of a mathematical algorithm utilized for the comparison of sequences is the algorithm of Myers and Miller, (1988) CABIOS 4:11-17. Such an algorithm is incorporated into the ALIGN program (version 2.0), which is part of the GCG Wisconsin Genetics Software Package, Version 10 (available from Accelrys, Inc., 9685 Scranton Rd., San Diego, Calif., USA). When utilizing the ALIGN program for comparing amino acid sequences, a PAM120 weight residue table, a gap length penalty of 12, and a gap penalty of 4 can be used.

Another non-limiting example of a mathematical algorithm utilized for the comparison of sequences is the algorithm of Needleman and Wunsch, (1970) J. Mol. Biol. 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

The embodiments also encompass nucleic acid molecules encoding PtIP-50 polypeptide variants. "Variants" of the PtIP-50 polypeptide encoding nucleic acid sequences include those sequences that encode the PtIP-50 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the PtIP-50 polypeptides disclosed as discussed below.

The present disclosure provides isolated or recombinant polynucleotides that encode any of the PtIP-50 polypeptides disclosed herein. Those having ordinary skill in the art will readily appreciate that due to the degeneracy of the genetic code, a multitude of nucleotide sequences encoding PtIP-50 polypeptides of the present disclosure exist. Table 1 is a codon table that provides the synonymous codons for each amino acid. For example, the codons AGA, AGG, CGA, CGC, CGG, and CGU all encode the amino acid arginine. Thus, at every position in the nucleic acids of the disclosure where an arginine is specified by a codon, the codon can be altered to any of the corresponding codons described above without altering the encoded polypeptide. It is understood that U in an RNA sequence corresponds to T in a DNA sequence.

TABLE 1

| Alanine | Ala | GCA GCC GCG GC |
|---|---|---|
| Cysteine | Cys | UGC UGU |
| Aspartic ac d | Asp | GAC GA |
| Glutamic acid | Glu | GAA GAG |
| Phenylalanine | Phe | UUC UUU |
| G ycine | Gly | GGA GGC GGG GGU |
| His idine | His | CAC CAU |
| Isoleucine | II | AUA AUC AUU |
| Lysine | Lys | AAA AAG |
| Leucine | Leu | UUA UUG CUA CUC CUG C U |
| Methionine | Met | AUG |
| Aspa agine | As | AAC AAU |
| Pro ine | Pro | CCA CCC CCG CCU |
| Glutamine | Gln | CAA CAG |
| Arginin | Arg | AGA AGG CGA CGC CGG CGU |
| erine | Ser | AGC AGU UCA UCC UCG UC |
| Threonine | Thr | ACA ACC ACG ACU |
| Valine | Val | GUA GUC GUG UU |
| Tryptophan | Trp | UGG |
| Tyrosine | Tyr | UAC UAU |

The skilled artisan will further appreciate that changes can be introduced by mutation of the nucleic acid sequences thereby leading to changes in the amino acid sequence of the encoded PtIP-50 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produces by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene*, 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A* 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundstrom, et al., (1985) *Nucl Acids Res* 13:3305-3316), double-strand break repair (Mandecki, (1986) *PNAS USA*, 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following US patents, PCT Publications and applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from ferns or other primitive plants, particularly a *Asplenium, Polypodium Adianturn, Platycerium, Nephrolepis, Ophioglossum, Colysis, Bolbitis, Blechnurn, Selaginella, Lycopodium*, and *Huperzia* species. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential PtIP-50 polypeptides and/or PtIP-65 polypeptides from fern or moss collections, the fern or moss cell lysates can be screened with antibodies generated against a PtIP-50 polypeptides and/or PtIP-65 polypeptides using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of PtIP-50 polypeptides and/or PtIP-65 polypeptides using protocols in the literatures (Scott Patterson, (1998), 10.22, 1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to PtIP-50 polypeptides and/or PtIP-65 polypeptides) with sequence information of PtIP-50 polypeptides of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or PtIP-65 polypeptides (e.g., SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42)) and its homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known PtIP-50 polypeptide or PtIP-65 polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding a PtIP-50 polypeptide or PtIP-65 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding a PtIP-50 polypeptide and/or PtIP-65 polypeptide, disclosed herein or one or more portions thereof may be used as a probe capable of specifically hybridizing to corresponding nucleic acid sequences encoding PtIP-50 polypeptide or PtIP-65 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length.

Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours.

Specificity is typically the function of post-hybridization washes, the critical factors being the ionic strength and temperature of the final wash solution. For DNA-DNA hybrids, the Tm can be approximated from the equation of Meinkoth and Wahl, (1984) *Anal. Biochem.* 138:267-284: Tm=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The Tm is the temperature (under defined ionic strength and pH) at which 50% of a complementary target sequence hybridizes to a perfectly matched probe. Tm is reduced by about 1° C. for each 1% of mismatching; thus, Tm, hybridization, and/or wash conditions can be adjusted to hybridize to sequences of the desired identity. For example, if sequences with ≥90% identity are sought, the Tm can be decreased 10° C. Generally, stringent conditions are selected to be about 5° C. lower than the thermal melting point (Tm) for the specific sequence and its complement at a defined ionic strength and pH. However, severely stringent conditions can utilize a hybridization and/or wash at 1, 2, 3 or 4° C. lower than the thermal melting point (Tm); moderately stringent conditions can utilize a hybridization and/or wash at 6, 7, 8, 9 or 10° C. lower than the thermal melting point (Tm); low stringency conditions can utilize a hybridization and/or wash at 11, 12, 13, 14, 15 or 20° C. lower than the thermal melting point (Tm). Using the equation, hybridization and wash compositions, and desired Tm, those of ordinary skill will understand that variations in the stringency of hybridization and/or wash solutions are inherently described. If the desired degree of mismatching results in a Tm of less than 45° C. (aqueous solution) or 32° C. (formamide solution), it is preferred to increase the SSC concentration so that a higher temperature can be used. An extensive guide to the hybridization of nucleic acids is found in Tijssen, (1993) Laboratory Techniques in Biochemistry and Molecular Biology-Hybridization with Nucleic Acid Probes, Part I, Chapter 2 (Elsevier, N.Y.); and Ausubel, et al., eds. (1995) Current Protocols in Molecular Biology, Chapter 2 (Greene Publishing and Wiley-Interscience, New York). See, Sambrook, et al., (1989) Molecular Cloning: A Laboratory Manual (2d ed., Cold Spring Harbor Laboratory Press, Cold Spring Harbor, N.Y.).

Proteins and Variants and Fragments Thereof

PtIP-50 polypeptides and PtIP-65 polypeptides are also encompassed by the disclosure. "*Pteridophyta* Insecticidal Protein-50" "PtIP-50 polypeptide", and "PtIP-50 protein" as used herein interchangeably refers to a polypeptide having insecticidal activity including but not limited to insecticidal activity against one or more insect pests of the Lepidoptera and/or Coleoptera orders, and is sufficiently homologous to the protein of SEQ ID NO: 71. A variety of PtIP-50 polypeptides are contemplated. Sources of PtIP-50 polypeptides or related proteins are fern species selected from but not limited to *Asplenium australasicum, Asplenium nidus, Asplenium×kenzoi* Sa. Kurata, *Polypodium musifolium, Polypodium punctatum* 'Serratum', *Adiantum pedatum* L., *Platycerium bifurcatum, Nephrolepis falcata, Colysis wrightii* 'Monstifera', *Colysis wrightii, Bolbitis cladorrhizans,* and *Blechnum brasiliense* 'Crispum'. "*Pteridophyta* Insecticidal Protein-65" "PtIP-65 polypeptide", and "PtIP-65 protein" as used herein interchangeably refers to a polypeptide having insecticidal activity including but not limited to insecticidal activity against one or more insect pests of the Lepidoptera and/or Coleoptera orders, and is sufficiently homologous to the protein of SEQ ID NO: 22. A variety of PtIP-65 polypeptides are contemplated. Sources of PtIP-65 polypeptides or related proteins are fern species selected from but not limited to: *Asplenium australasicum, Asplenium×kenzoi* Sa. Kurata, *Polypodium musifolium, Polypodium punctatum* 'Serratum', *Adiantum pedatum* L., *Platycerium bifurcatum, Nephrolepis falcata, Ophioglossum pendulum, Colysis wrightii* 'Monstifera', *Colysis wrightii, Selaginella kraussiana* 'Variegata', *Selaginella victoriae, Lycopodium phlehmaria,* and *Huperzia salvinioides*.

"Sufficiently homologous" is used herein to refer to an amino acid sequence that has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. In some embodiments the sequence homology is against the full length sequence of a PtIP-50 polypeptide. In some embodiments the PtIP-50 polypeptide has at least about 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 71. In some embodiments the sequence homology is against the full length sequence a PtIP-65 polypeptide. In some embodiments the PtIP-65 polypeptide has at least about 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 22. One of skill in the art will recognize that these values can be appropriately adjusted to determine corresponding homology of proteins taking into account amino acid similarity and the like. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. A PtIP-50 polypeptide or PtIP-65 polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to a PtIP-50 polypeptide or PtIP-65 polypeptide and that exhibit insecticidal activity. "Fragments" or "biologically active portions" of PtIP-50 polypeptides includes fragments comprising amino acid sequences sufficiently identical to the amino acid sequence set forth in SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98, wherein the PtIP-50 polypeptide, in combination with a PtIP-65 polypeptide, has insecticidal activity. "Fragments" or "biologically active portions" of PtIP-65 polypeptides includes fragments comprising amino acid sequences sufficiently identical to the amino acid sequence set forth in SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42, wherein the PtIP-65 polypeptide, in combination with a PtIP-50 polypeptide, has insecticidal activity. Such biologically active portions can be prepared by recombinant techniques and evaluated for insecticidal activity. In some embodiments, the PtIP-50 polypeptide fragment is an N-terminal and/or a C-terminal truncation of at least about 1, 2, 3, 4, 5, 6, 7, 8, 9, 10, 11, 12, 13, 14, 15, 16, 17, 18, 19, 20, 25, 26, 27, 28, 29, 30, 31, 32, 33, 34 or more amino acids from the N-terminus and/or C-terminus relative to SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98 e.g., by proteolysis, by insertion of a start codon, by deletion of the codons encoding the deleted amino acids and concomitant insertion of a start codon, and/or insertion of a stop codon.

In some embodiments, the PtIP-50 polypeptide fragments encompassed herein result from the removal of the N-terminal 1, 2, 3, 4, 5, 6, 7, 8, 9 or 10 or more amino acids relative to SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98 or variants thereof, e.g., by proteolysis or by insertion of a start codon, by deletion of the codons encoding the deleted amino acids and concomitant insertion of a start codon.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% identical to the parental amino acid sequence.

PtIP-50 Polypeptides

In some embodiments a PtIP-50 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity across the entire length of the amino acid sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 71, SEQ ID NO: 77, SEQ ID NO: 78, SEQ ID NO: 84 or SEQ ID NO: 96, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 71, SEQ ID NO: 77, SEQ ID NO: 78, SEQ ID NO: 84 or SEQ ID NO: 96, wherein the PtIP-50 polypeptide, in combination with a PtIP-65 polypeptide, has insecticidal activity.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 72, SEQ ID NO: 73, SEQ ID NO: 74, SEQ ID NO: 79, SEQ ID NO: 85, SEQ ID NO: 89, SEQ ID NO: 93 or SEQ ID NO: 94, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 72, SEQ ID NO: 73, SEQ ID NO: 74, SEQ ID NO: 79, SEQ ID NO: 85, SEQ ID NO: 89, SEQ ID NO: 93 or SEQ ID NO: 94, wherein the PtIP-50 polypeptide, in combination with a PtIP-65 polypeptide, has insecticidal activity.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 75, SEQ ID NO: 81, SEQ ID NO: 82, SEQ ID NO: 87 or SEQ ID NO: 98, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 75, SEQ ID NO: 81, SEQ ID NO: 82, SEQ ID NO: 87 or SEQ ID NO: 98, wherein the PtIP-50 polypeptide, in combination with a PtIP-65 polypeptide, has insecticidal activity.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 76, SEQ ID NO: 80, SEQ ID NO: 88 or SEQ ID NO: 92, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 76, SEQ ID NO: 80, SEQ ID NO: 88 or SEQ ID NO: 92, wherein the PtIP-50 polypeptide, in combination with a PtIP-65 polypeptide, has insecticidal activity.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 83, SEQ ID NO: 86, SEQ ID NO: 90 or SEQ ID NO: 91, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 83, SEQ ID NO: 86, SEQ ID NO: 90 or SEQ ID NO: 91, wherein the PtIP-50 polypeptide, in combination with a PtIP-65 polypeptide, has insecticidal activity.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 97, wherein the PtIP-50 polypeptide, in combination with a PtIP-65 polypeptide, has insecticidal activity.

In some embodiments a PtIP-50 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 97, wherein the PtIP-50 polypeptide, in combination with a PtIP-65 polypeptide, has insecticidal activity.

In some embodiments a PtIP-50 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to any one of the amino acid sequences of SEQ ID NO: 224-326, wherein the PtIP-50 polypeptide, in combination with a PtIP-65 polypeptide, has insecticidal activity.

In some embodiments a PtIP-50 polypeptide comprises an amino acid sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino acid substitutions compared to the native amino acid at the corresponding position of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98.

In some embodiments the sequence identity is across the entire length of the polypeptide calculated using ClustalW algorithm in the ALIGNX® module of the Vector NTI® Program Suite (Invitrogen Corporation, Carlsbad, Calif.) with all default parameters.

In some embodiments a PtIP-50 polypeptide comprises an amino acid sequence having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59 or 60 amino acid substitutions, in any combination, compared to the native amino acid at the corresponding position of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98.

In some embodiments a PtIP-50 polypeptide comprises an amino acid sequence having 1, 2, 3, 4, 5, 6, 7, 8, 9, 10 11, 12, 13, 14, 15, 16, 17, 18, 19, 20, 21, 22, 23, 24, 25, 26, 27, 28 or 29 amino acid substitutions, in any combination, compared to the native amino acid at the corresponding position of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98.

In some embodiments the PtIP-50 polypeptide comprises an amino acid sequence of SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97 or SEQ ID NO: 98.

In some embodiments the nucleic acid molecule encoding the PtIP-50 polypeptide is derived from a fern species in the Division *Pteridophyta*. In some embodiments the PtIP-50 polypeptide is derived from a fern species in the Class Psilotopsida. In some embodiments the PtIP-50 polypeptide is derived from a fern species in the Class Psilotopsida, Order Psilotales. In some embodiments the PtIP-50 polypeptide is derived from a fern species in the Class Psilotopsida, Order Ophioglossales. In some embodiments the PtIP-50 polypeptide is derived from a fern species in the Class Psilotopsida, Order Ophioglossales, Family Psilotaceae. In some embodiments the PtIP-50 polypeptide is derived from a fern species in the Class Psilotopsida, Order Ophioglossales Family Ophioglossaceae. In some embodiments the PtIP-50 polypeptide is derived from a fern species in the Genus *Ophioglossum* L., *Bottychium, Botrypus, Helminthostachys, Ophioderma, Cheiroglossa, Sceptridium* or *Mankyua*. In some embodiments the PtIP-50 polypeptide is derived from a fern species in the Genus *Ophioglossum* L. is selected from but not limited to *Ophioglossum californicum, Ophioglossum coriaceum, Ophioglossum costatum, Ophioglossum crotalophoroides, Ophioglossum engelmannii, Ophioglossum falcaturn, Ophioglossum gomezianurn, Ophioglossum gramineum, Ophioglossum kawamurae, Ophioglossum lusitanicum, Ophioglossum namegatae, Ophioglossum nudicaule, Ophioglossum palmatum, Ophioglossum parvum, Ophioglossum pedunculosum, Ophioglossum pendulum, Ophioglossum petiolatum, Ophioglossum pusillum, Ophioglossum reticulatum, Ophioglossum richardsiae, Ophioglossum thermale,* and *Ophioglossum vulgatum.*

In some embodiments the PtIP-50 polypeptide is derived from a species in the Class Polypodiopsida/Pteridopsida. In some embodiments the PtIP-50 polypeptide is derived from a fern species in the Order Osmundales (royal ferns); Family Osmundaceae. In some embodiments the PtIP-50 polypeptide is derived from a fern species in the Order Hymenophyllales (filmy ferns and bristle ferns); Family Hymenophyllaceae. In some embodiments the PtIP-50 polypeptide is derived from a fern species in the Order Gleicheniales; Family Gleicheniaceae, Family Dipteridaceael or Family Matoniaceae. In some embodiments the PtIP-50 polypeptide is derived from a fern species in the Order Schizaeales; Family Lygodiaceae, Family Anemiaceae or Family Schizaeaceae. In some embodiments the PtIP-50 polypeptide is derived from a fern species in the Order Salviniales; Family Marsileaceae or Family Salviniaceae. In some embodiments the PtIP-50 polypeptide is derived from a fern species in the Order Cyatheales; Family Thyrsopteridaceae, Family Loxsomataceae, Family Culcitaceae, Family Plagiogyriaceae, Family Cibotiaceae, Family Cyatheaceae, Family Dicksoniaceae or Family Metaxyaceae.

In some embodiments the PtIP-50 polypeptide is derived from a fern species in the Order Polypodiales; Family Lindsaeaceae, Family Saccolomataceae, Family Cystodiaceae, Family Dennstaedtiaceae, Family Pteridaceae, Family Aspleniaceae, Family Thelypteridaceae, Family Woodsiaceae, Family Onocleaceae, Family Blechnaceae, Family Dryopteridaceae, Family Lomariopsidaceae, Family Tectariaceae, Family Oleandraceae, Family Davalliaceae or Family Polypodiaceae.

In some embodiments the PtIP-50 polypeptide is derived from a fern species in the Order Polypodiales, Family Pteridaceae, Genus *Adiantaceae* selected from but not limited to *Adiantum aethiopicum, Adiantum aleuticum, Adiantum bonatianum, Adiantum cajennense, Adiantum capillus-junonis, Adiantum capillus-veneris, Adiantum caudatum, Adiantum chienfi, Adiantum chilense, Adiantum cuneatum, Adiantum cunninghamfi, Adiantum davidii, Adiantum diaphanum, Adiantum edentulum, Adiantum edgeworthfi, Adiantum excisum, Adiantum fengianum, Adiantum fimbriatum, Adiantum flabellulaturn, Adiantum formosanum, Adiantum formosum, Adiantum fulvum, Adiantum gravesfi, Adiantum hispidulum, Adiantum induratum, Adiantum jordanfi, Adiantum juxtapositum, Adiantum latifolium, Adiantum leveillei, Adiantum lianxianense, Adiantum malesianum, Adiantum mariesfi, Adiantum monochlamys, Adiantum myriosorum, Adiantum obliquum, Adiantum ogasawarense, Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum venustum, Adiantum viridescens,* and *Adiantum viridimontanurn.*

In some embodiments the PtIP-50 polypeptide is derived from a fern species in the Order Polypodiales, Family Aspleniaceae, Genus *Asplenium* L. In some embodiments the PtIP-50 polypeptide is derived from a fern species in the Order Polypodiales, Family Aspleniaceae, Genus *Asplenium* L selected from but not limited to *Asplenium abbreviatum, Asplenium abrotanoides, Asplenium abscissum* var. *subaequilaterale, Asplenium abscissum, Asplenium achilleifolium, Asplenium acuminatum, Asplenium adiantifrons, Asplenium adiantoides, Asplenium adiantoides* var. *squamulosum, Asplenium adiantum-nigrum* L., *Asplenium adiantum-nigrum* var. *adiantum-nigrum, Asplenium adiantum-nigrum* var. *yuanurn, Asplenium adnatum, Asplenium aethiopicum, Asplenium affine, Asplenium affine* var. *affine, Asplenium affine* var. *gilpinae, Asplenium affine* var. *mettenii, Asplenium affine* var. *pecten, Asplenium africanum, Asplenium afzelii, Asplenium aitchisonii, Asplenium alatulum, Asplenium alatum, Asplenium alfredii, Asplenium altajense, Asplenium amabile, Asplenium ambohitantelense, Asplenium anceps* var. *proliferum, Asplenium andapense, Asplenium andersonii, Asplenium angustatum, Asplenium angustum, Asplenium anisophyllum, Asplenium annetii, Asplenium antiquum, Asplenium antrophyoides, Asplenium apertura, Asplenium apogamum, Asplenium aquaticum, Asplenium arboreum, Asplenium arcanum, Asplenium arcuatum, Asplenium argentinurn, Asplenium argutum, Asplenium aspidiiforme, Asplenium aspidioides, Asplenium asterolepis, Asplenium auricularium* var. *acutidens, Asplenium auricularium* var. *subintegerrimum, Asplenium auriculatum, Asplenium auriculaturn* var. *aequilaterale, Asplenium auritum* fo. *diversifolium, Asplenium auritum* fo. *diversifolium, Asplenium auritum* fo. *nana, Asplenium auritum, Asplenium auritum* var. *auriculaturn, Asplenium auritum* var. *auritum, Asplenium auritum* var. *bipinnatifidum, Asplenium auritum* var. *bipinnatisectum, Asplenium auritum* var. *davallioides, Asplenium auritum* var. *macilentum, Asplenium auritum* var. *rigidum, Asplenium auritum* var. *subsimplex, Asplenium austrochinense, Asplenium ayopayense, Asplenium badinii, Asplenium balense, Asplenium ballivianii, Asplenium bangii, Asplenium bangii, Asplenium barbaense, Asplenium barclayanum, Asplenium barkamense, Asplenium barteri, Asplenium basiscopicum, Asplenium bicrenaturn, Asplenium bifrons, Asplenium bipartitum, Asplenium blastophorum, Asplenium blepharodes, Asplenium blepharophorum, Asplenium boiteaui, Asplenium bolivianum, Asplenium boltonii, Asplenium borealichinense, Asplenium bradei, Asplenium bradeorum, Asplenium bradleyi, Asplenium brausei, Asplenium breedlovei, Asplenium buettneri, Asplenium buettneri* var. *hildebrandtii, Asplenium bulbiferum, Asplenium bullaturn* var. *bullaturn, Asplenium bullatum* var. *shikokianum, Asplenium bullaturn, Asplenium cancellatum, Asplenium capillipes, Asplenium cardiophyllum* (Hance), *Asplenium caripense, Asplenium carvalhoanum, Asplenium castaneoviride, Asplenium castaneum, Asplenium caudatum, Asplenium celtidifolium* (Kunze), *Asplenium ceratolepis, Asplenium changputungense, Asplenium chaseanum, Asplenium cheilosorum, Asplenium chengkouense, Asplenium chihuahuense, Asplenium chimantae, Asplenium chimborazense, Asplenium chingianum, Asplenium chlorophyllum, Asplenium chondrophyllum, Asplenium cicutarium, Asplenium cicutarium* var. *paleaceum, Asplenium cirrhaturn, Asplenium cladolepton, Asplenium claussenii, Asplenium coenobiale, Asplenium commutatum, Asplenium congestum, Asplenium conquisitum, Asplenium consimile, Asplenium contiguum, Asplenium contiguum* var. *hirtulum, Asplenium corderoi, Asplenium cordovense, Asplenium coriaceum, Asplenium corfifolium, Asplenium correardii, Asplenium costale, Asplenium costale* var. *robustum, Asplenium cowanii, Asplenium crenulatoserrulatum, Asplenium crenulatum, Asplenium crinicaule, Asplenium crinulosum, Asplenium cristatum, Asplenium ctyptolepis* Fernald, *Asplenium cultrifolium* L., *Asplenium cuneatiforme, Asplenium cuneatum, Asplenium curvatura, Asplenium cuspidatum, Asplenium cuspidatum* var *cuspidatum, Asplenium cuspidatum* var. *foeniculaceum, Asplenium cuspidatum* var. *triculum, Asplenium cuspidatum* var. *tripinnaturn, Asplenium dalhousiae, Asplenium dareoides, Asplenium davallioides, Asplenium davisii, Asplenium debile, Asplenium debile, Asplenium decussatum, Asplenium delavayi, Asplenium delicatulum, Asplenium delicatulum* var. *cocosensis, Asplenium delitescens, Asplenium delitescens×laetum, Asplenium densum, Asplenium dentatum* L., *Asplenium dentatum* L., *Asplenium depauperatum, Asplenium deqenense, Asplenium dianae, Asplenium difforme, Asplenium dilatatum, Asplenium dimidiatum, Asplenium dimidiaturn* var. *boliviense, Asplenium diplazisorum, Asplenium dissectum, Asplenium distans, Asplenium divaricatum, Asplenium divergens, Asplenium divisissimurn, Asplenium doederleinii, Asplenium donnell-smithii, Asplenium dregeanum, Asplenium dulongjiangense, Asplenium duplicatoserratum, Asplenium eatonii, Asplenium ebeneum, Asplenium ebenoides, Asplenium ecuadorense, Asplenium eggersii, Asplenium emarginaturn, Asplenium enaturn, Asplenium ensiforme* fo. *bicuspe, Asplenium ensiforme* fo. *ensiforme, Asplenium ensiforme* fo. *stenophyllum, Asplenium ensiforme, Asplenium erectum* var. *erectum, Asplenium erectum* var. *gracile, Asplenium erectum* var. *usambarense, Asplenium erectum* var. *zeyheri,* &, *Asplenium erosum* L., *Asplenium escaleroense, Asplenium esculenturn, Asplenium eutecnurn, Asplenium excelsum, Asplenium excisum, Asplenium exiguum, Asplenium extensum, Asplenium falcatum, Asplenium falcinellum, Asplenium faurei, Asplenium feei, Asplenium fengyangshanense, Asplenium ferulaceum, Asplenium fibrillosum, Asplenium filix-femina, Asplenium finckii, Asplenium finlaysonianurn, Asplenium flabellulatum, Asplenium flabellulatum* var *flabellulatum, Asplenium flabellulatum* var. *partitum, Asplenium flaccidum, Asplenium flavescens, Asplenium flavidum, Asplenium flexuosum, Asplenium fluminense, Asplenium foeniculaceum, Asplenium formosanum, Asplenium formosum* var. *carolinurn, Asplenium formosum* var. *incultum, Asplenium formosum, Asplenium fournieri, Asplenium fragile, Asplenium fragile* var. *lomense, Asplenium fragrans, Asplenium fragrans* var. *foeniculaceum, Asplenium franconis* var. *gracile, Asplenium fraxinifolium, Asplenium friesiorum, Asplenium friesiorum* var. *nesophilum, Asplenium fugax, Asplenium fujianense, Asplenium furcatum, Asplenium furfuraceum, Asplenium fuscipes, Asplenium fuscopubescens, Asplenium galeottii, Asplenium gautieri, Asplenium gemmiferum, Asplenium gentryi, Asplenium geppii, Asplenium ghiesbreghtii, Asplenium gilliesii, Asplenium gilpinae, Asplenium glanduliserratum, Asplenium glenniei, Asplenium goldmannii, Asplenium gomezianum, Asplenium grande, Asplenium grandifolium, Asplenium grandifrons, Asplenium gregoriae, Asplenium griffithianum, Asplenium gulingense, Asplenium hainanense, Asplenium hallbergii, Asplenium hallei, Asplenium hallii, Asplenium hangzhouense, Asplenium haplophyllum, Asplenium harpeodes, Asplenium harpeodes* var. *glaucovirens, Asplenium harpeodes* var. *incisura, Asplenium harrisii* Jenman, *Asplenium harrisonii, Asplenium hastatum, Asplenium hebeiense, Asplenium hemionitideum, Asplenium hemitomurn, Asplenium henryi, Asplenium herpetopteris, Asplenium herpetopteris* var *herpetopteris, Asplenium herpetopteris* var. *acutipinnata, Asplenium herpetopteris* var. *masoulae, Asplenium*

*herpetopteris* var. *villosum, Asplenium hesperium, Asplenium heterochroum, Asplenium hians, Asplenium hians* var. *pallescens, Asplenium hoffmannii, Asplenium holophlebium, Asplenium hondoense, Asplenium horridum, Asplenium hostmannii, Asplenium humistratum, Asplenium hypomelas, Asplenium inaequilaterale, Asplenium incisura, Asplenium incurvaturn, Asplenium indicum, Asplenium indicum* var. *indicum, Asplenium indicum* var. *yoshingagae, Asplenium induratum, Asplenium indusiatum, Asplenium inexpectatum, Asplenium insigne, Asplenium insiticium, Asplenium insolitum, Asplenium integerrimurn, Asplenium interjectum, Asplenium jamesonii, Asplenium jaundeense, Asplenium juglandifolium, Asplenium kangdingense, Asplenium kansuense, Asplenium kassneri, Asplenium kaulfussii, Asplenium kellermanii, Asplenium kentuckiense, Asplenium khullarii, Asplenium kiangsuense, Asplenium kunzeanurn, Asplenium lacerum, Asplenium laciniatum, Asplenium laciniatum* var. *acutipinna, Asplenium laciniatum* var. *laciniatum, Asplenium laetum* fo. *minor, Asplenium laetum, Asplenium laetum* var. *incisoserratum, Asplenium lamprocaulon, Asplenium laserpitiifolium* var. *morrisonense, Asplenium lastii, Asplenium latedens, Asplenium latifolium, Asplenium laui, Asplenium laurentii, Asplenium leandrianurn, Asplenium lechleri, Asplenium leiboense, Asplenium lepidorachis, Asplenium leptochlamys, Asplenium leptophyllum, Asplenium levyi, Asplenium lindbergii, Asplenium lindeni, Asplenium lineatum, Asplenium lividum, Asplenium lobatum, Asplenium lobulaturn, Asplenium lokohoense, Asplenium longicauda, Asplenium longicaudaturn, Asplenium longifolium, Asplenium longisorum, Asplenium longjinense, Asplenium lorentzii, Asplenium loriceum, Asplenium loxogrammoides, Asplenium lugubre, Asplenium lunulatum, Asplenium lunulatum* var. *pteropus, Asplenium lushanense, Asplenium lydgatei, Asplenium macilentum, Asplenium macraei, Asplenium macrodictyon, Asplenium macrophlebium, Asplenium macrophyllum, Asplenium macropterum, Asplenium macrosorum, Asplenium macrotis, Asplenium macrurum, Asplenium mainlingense, Asplenium mangindranense, Asplenium mannii, Asplenium marginatum* L., *Asplenium marojejyense, Asplenium martianum, Asplenium matsumurae, Asplenium mauritiensis* Lorence, *Asplenium maximum, Asplenium, ii, Asplenium megalura, Asplenium megaphyllum, Asplenium meiotomurn, Asplenium melanopus, Asplenium membranifolium, Asplenium meniscioides, Asplenium mesosorum, Asplenium mexicanurn, Asplenium micropaleatum, Asplenium microtum, Asplenium mildbraedii, Asplenium mildei, Asplenium minimum, Asplenium minutum, Asplenium miradorense, Asplenium miyunense, Asplenium moccenianum, Asplenium mocquetysii, Asplenium modestum, Asplenium monanthemum* var. *menziesii, Asplenium monanthes* L., *Asplenium monanthes* var *monanthes, Asplenium monanthes* var. *castaneum, Asplenium monanthes* var. *wagneri, Asplenium monanthes* var. *yungense, Asplenium monodon, Asplenium montanum, Asplenium mosetenense, Asplenium moupinense, Asplenium mucronatum, Asplenium munchii, Asplenium muticum, Asplenium myapteron, Asplenium myriophyllu, Asplenium nakanoanum, Asplenium nanchuanense, Asplenium nemorale, Asplenium neolaserpitiifolium, Asplenium neomutijugum, Asplenium neovarians, Asplenium nesii, Asplenium nesioticum, Asplenium nidus* L., *Asplenium nigricans, Asplenium niponicum, Asplenium normale, Asplenium normale* var. *angustum, Asplenium obesum, Asplenium oblongatum, Asplenium oblongifolium, Asplenium obovatum, Asplenium obscurum, Asplenium obscurum* var. *angustum, Asplenium obtusatum* var. *obtusatum, Asplenium obtusatum* var. *sphenoides, Asplenium obtusifolium* L., *Asplenium obtusissimum, Asplenium obversum, Asplenium ochraceum, Asplenium oellgaardii, Asplenium ofeliae, Asplenium oldhami, Asplenium oligosorum, Asplenium olivaceum, Asplenium onopteris* L., *Asplenium onustum, Asplenium ortegae, Asplenium otites, Asplenium palaciosii, Asplenium palmeri, Asplenium partitum, Asplenium parvisorum, Asplenium parviusculum, Asplenium parvulum, Asplenium patens, Asplenium paucifolium, Asplenium paucijugum, Asplenium paucivenosum, Asplenium pearcei, Asplenium pekinense, Asplenium pellucidum, Asplenium pendulum, Asplenium petiolulatum, Asplenium phyllitidis, Asplenium pimpinellifolium, Asplenium pinnatifidum, Asplenium pinnatum, Asplenium platyneuron, Asplenium platyneuron* var. *bacculum-rubrum, Asplenium platyneuron* var. *incisum, Asplenium platyphyllum, Asplenium plumbeum, Asplenium poloense, Asplenium polymeris, Asplenium polymorphum, Asplenium polyodon, Asplenium polyodon* var. *knudsenii, Asplenium polyodon* var. *nitidulum, Asplenium polyodon* var. *sectum, Asplenium polyodon* var. *subcaudatum, Asplenium polyphyllum, Asplenium poolii, Asplenium poolii* fo. *simplex, Asplenium poolii* var. *linearipinnatum, Asplenium potosinum, Asplenium potosinum* var. *incisum, Asplenium praegracile, Asplenium praemorsum, Asplenium preussii, Asplenium pringleanum, Asplenium pringlei, Asplenium prionitis, Asplenium procerum, Asplenium progrediens, Asplenium projectum, Asplenium prolongatum, Asplenium propinquum, Asplenium protensum, Asplenium pseudoangustum, Asplenium pseudoerectum, Asplenium pseudofontanum, Asplenium pseudolaserpitiifolium, Asplenium pseudonormale, Asplenium pseudo pellucidum, Asplenium pseudopraemorsum, Asplenium pseudovarians, Asplenium pseudowilfordii, Asplenium pseudowrightii, Asplenium psilacrum, Asplenium pteropus, Asplenium pubirhizoma, Asplenium pulchellum, Asplenium pulchellum* var. *subhorizontale, Asplenium pulcherrimum, Asplenium pulicosum, Asplenium pulicosum* var. *maius, Asplenium pululahuae, Asplenium pumilum, Asplenium pumilum* var. *hymenophylloides, Asplenium pumilum* var. *laciniatum, Asplenium purdieanum, Asplenium purpurascens, Asplenium pyramidatum, Asplenium qiujiangense, Asplenium quercicola, Asplenium quitense, Asplenium raddianum, Asplenium radiatum, Asplenium radicans* L., *Asplenium radicans, Asplenium radicans* var. *costaricense, Asplenium radicans* var. *partitum, Asplenium radicans* var. *radicans, Asplenium radicans* var. *uniseriale, Asplenium recumbens, Asplenium reflexum, Asplenium regulare* var. *latior, Asplenium repandulum, Asplenium repens, Asplenium repente, Asplenium resiliens, Asplenium retusulum, Asplenium rhipidoneuron, Asplenium rhizophorum* L., *Asplenium rhizophyllum, Asplenium rhizophyllum* L., *Asplenium rhizophyllum* var. *proliferum, Asplenium rhomboideum, Asplenium rigidum, Asplenium riparium, Asplenium rivale, Asplenium rockii, Asplenium roemerianum, Asplenium roemerianum* var. *mindensis, Asplenium rosenstockianum, Asplenium rubinum, Asplenium ruizianum, Asplenium rusbyanum, Asplenium ruta-muraria* L., *Asplenium ruta-muraria* var. *cryptolepis, Asplenium rutaceum, Asplenium rutaceum* var. *disculiferum, Asplenium rutaefolium, Asplenium rutifolium, Asplenium salicifolium* L., *Asplenium salicifolium* var. *aequilaterale, Asplenium salicifolium* var. *salicifolium, Asplenium sampsoni, Asplenium sanchezii, Asplenium sanderi, Asplenium sandersonii, Asplenium sanguinolentum, Asplenium sarelii, Asplenium sarelii* var. *magnum, Asplenium sarelii* var. *sarelii, Asplenium saxicola, Asplenium scalifolium, Asplenium scandicinum, Asplenium schizophyllum, Asplenium schkuhrii, Asplenium sciadophilum, Asplenium scolopendrium* L., *Asplenium scortechinii, Asplenium seileri, Asplenium semipinnatum, Asplenium sep-* tentrionale, Asplenium serra, Asplenium serra var. imrayanum, Asplenium serratissimum, Asplenium serratum L., Asplenium serratum var. caudatum, Asplenium serricula, Asplenium sessilifolium, Asplenium sessilifolium var. guatemalense, Asplenium sessilifolium var. minus, Asplenium sessilifolium var. occidentale, Asplenium sessilipinnum, Asplenium setosum, Asplenium shepherdii, Asplenium shepherdii var. bipinnatum, Asplenium shepherdii var. flagelliferum, Asplenium shikokianum, Asplenium simii, Asplenium simonsianum, Asplenium sintenisii, Asplenium skinneri, Asplenium skinneri, Asplenium sodiroi, Asplenium soleirolioides, Asplenium solidum var. stenophyllum, Asplenium solmsii, Asplenium sp.-N.-Halle-2234, Asplenium spathulinum, Asplenium spectabile, Asplenium speluncae, Asplenium sphaerosporum, Asplenium sphenotomum, Asplenium spinescens, Asplenium splendens, Asplenium sprucei, Asplenium squamosum L., Asplenium standleyi, Asplenium stellatum, Asplenium stenocarpum, Asplenium stoloniferum, Asplenium stolonipes, Asplenium striatum L., Asplenium stuebelianum, Asplenium stuhlmannii, Asplenium suave, Asplenium subalatum, Asplenium subcrenaturn, Asplenium subdigitatum, Asplenium subdimidiatum, Asplenium subintegrum, Asplenium sublaserpitfifolium, Asplenium sublongum, Asplenium subnudum, Asplenium suborbiculare, Asplenium subtenuifolium, Asplenium subtile, Asplenium subtoramanurn, Asplenium subtrapezoideum, Asplenium subvarians, Asplenium sulcatum, Asplenium sylvaticum, Asplenium szechuanense, Asplenium taiwanense, Asplenium tenerrimum, Asplenium tenerum, Asplenium tenuicaule, Asplenium tenuifolium, Asplenium tenuifolium var. minor, Asplenium tenuifolium var. tenuifolium, Asplenium tenuissimum, Asplenium ternatum, Asplenium theciferum, Asplenium theciferum var. concinnum, Asplenium thunbergii, Asplenium tianmushanense, Asplenium tianshanense, Asplenium tibeticum, Asplenium tocoraniense, Asplenium toramanurn, Asplenium trapezoideum, Asplenium tricholepis, Asplenium trichomanes L., Asplenium trichomanes subsp. inexpectans, Asplenium trichomanes subsp. quadrivalens, Asplenium trichomanes subsp. trichomanes, Asplenium trichomanes var. harovii, Asplenium trichomanes var. herbaceum, Asplenium trichomanes var. repens, Asplenium trichomanes var. viridissimum, Asplenium trichomanes-dentatum L., Asplenium trigonopterum, Asplenium trilobatum, Asplenium trilobum, Asplenium triphyllum, Asplenium triphyllum var. cornpactum, Asplenium triphyllum var. gracillimum, Asplenium triphyllum var. herbaceum, Asplenium tripteropus, Asplenium triquetrum, Asplenium truncorum, Asplenium tsaratananense, Asplenium tucumanense, Asplenium tuerckheimii, Asplenium tunquiniense, Asplenium ulbrichtii, Asplenium ultimurn, Asplenium unilaterale, Asplenium unilaterale var. decurrens, Asplenium unilaterale var. udum, Asplenium unilaterale var. unilaterale, Asplenium uniseriale, Asplenium uropteron, Asplenium vagans, Asplenium vareschianum, Asplenium variabile var. paucijugum, Asplenium variabile var. variabile, Asplenium varians subsp. fimbriatum, Asplenium varians, Asplenium vastum, Asplenium venturae, Asplenium venulosum, Asplenium verapax, Asplenium vesiculosum, Asplenium vespertinurn, Asplenium villosum, Asplenium virens, Asplenium viride, Asplenium viridifrons, Asplenium virillae, Asplenium vivipariotides, Asplenium viviparum, Asplenium viviparum var viviparum, Asplenium viviparum var. lineatu, Asplenium volubile, Asplenium vulcanicum, Asplenium wacketii, Asplenium wagneri, Asplenium wallichianum, Asplenium wameckei, Asplenium wilfordii, Asplenium williamsii, Asplenium wrightii, Asplenium wrightioides, Asplenium wuliangshanense, Asplenium xianqianense, Asplenium xinjiangense, Asplenium xinyiense, Asplenium yelagagense, Asplenium yoshinagae, Asplenium yunnanense, Asplenium zamiifolium, Asplenium zanzibaricum, Asplenium biscayneanum, Asplenium curtissii, Asplenium ebenoides, Asplenium herb-wagneri, Asplenium heteroresiliens, Asplenium kenzoi, Asplenium plenum, Asplenium wangii, and Asplenium×clermontiae, Asplenium×gravesii.

In some embodiments the PtIP-50 polypeptide is derived from a fern species in the Order Polypodiales, Family Blechnaceae, Genus *Blechnum* L. In some embodiments the PtIP-50 polypeptide is derived from a fern species in the Order Polypodiales, Family Blechnaceae, Genus *Blechnum* L. selected from but not limited to *Blechnum amabile, Blechnum appendiculatum, Blechnum articulatum, Blechnum australe, Blechnum austrobrasilianum, Blechnum binervatum, Blechnum blechnoides, Blechnum brasiliense, Blechnum capense, Blechnum cartilagineum, Blechnum castaneum, Blechnum chambersii, Blechnum chilense, Blechnum colensoi, Blechnum contiguum, Blechnum cordatum, Blechnum coriaceum, Blechnum discolor, Blechnum doodioides, Blechnum durum, Blechnum eburneum, Blechnum ensiforme, Blechnum filiforme, Blechnum fluviatile, Blechnum fragile, Blechnum fraseri, Blechnum fullagari, Blechnum gibbum, Blechnum glandulosum, Blechnum gracile, Blechnum hancockii, Blechnum hastatum, Blechnum howeanum, Blechnum indicum, Blechnum kunthianum, Blechnum laevigatum, Blechnum loxense, Blechnum magellanicum, Blechnum membranaceum, Blechnum microbasis, Blechnum microphyllum, Blechnum milnei, Blechnum minus, Blechnum mochaenum, Blechnum montanum, Blechnum moorei, Blechnum moritzianum, Blechnum nigrum, Blechnum niponicum, Blechnum norfolkianum, Blechnum novaezelandiae, Blechnum nudum, Blechnum obtusatum, Blechnum occidentale, Blechnum oceanicum, Blechnum orientate, Blechnum patersonii, Blechnum penna-marina, Blechnum polypodioides, Blechnum procerum, Blechnum punctulatum, Blechnum sampaioanum, Blechnum schiedeanum, Blechnum schomburgkii, Blechnum serrulatum, Blechnum simillimum, Blechnum spicant, Blechnum stipitellatum, Blechnum tabulare, Blechnum triangularifolium, Blechnum vieillardii, Blechnum vulcanicum, Blechnum wattsii, Blechnum whelanii,* and *Blechnum wurunuran.*

In some embodiments the PtIP-50 polypeptide is derived from a fern species in the Order Polypodiales, Family Dryopteridaceae Genus *Acrophorus*, Genus *Acrorumohra*, Genus *Anapausia*, Genus *Arachniodes*, Genus *Bolbitis*, Genus *Ctenitis*, Genus *Cyclodium*, Genus *Cyrtogonellum*, Genus *Cyrtomidictyum*, Genus *Cyrtomium*, Genus *Diacalpe*, Genus *Didymochlaena*, Genus *Dryopsis*, Genus *Dryopteris*, Genus *Elaphoglossum*, Genus *Hypodematium*, Genus *Lastreopsis*, Genus *Leptorumohra*, Genus *Leucostegia*, Genus *Lithostegia*, Genus *Lomagramma*, Genus *Maxonia*, Genus *Megalastrum*, Genus *Olfersia*, Genus *Peranema*, Genus *Phanerophlebia*, Genus *Phanerophlebiopsis*, Genus *Polybotrya*, Genus *Polystichopsis*, Genus *Polystichum*, Genus *Rumohra*, Genus *Sorolepidium*, Genus *Stigmatopteris* or Genus *Teratophyllum*.

In some embodiments the PtIP-50 polypeptide is derived from a fern species in the Order Polypodiales, Family Dryopteridaceae, Genus *Bolbitis* selected from but not limited to *Bolbitis acrostichoides, Bolbitis aliena, Bolbitis angustipinna, Bolbitis appendiculata, Bolbitis auriculata, Bolbitis bemoullii, Bolbitis bipinnatifida, Bolbitis cadieri, Bolbitis christensenfi, Bolbitis confertifolia, Bolbitis costata, Bolbitis crispatula, Bolbitis fluviatilis, Bolbitis gaboonensis, Bolbitis gemmifera, Bolbitis hainanensis, Bolbitis hastata, Bolbitis hekouensis, Bolbitis hemiotis, Bolbitis heteroclita,*

*Bolbitis heudelotii, Bolbitis humblotii, Bolbitis interlineata, Bolbitis latipinna, Bolbitis laxireticulata, Bolbitis lindigii, Bolbitis lonchophora, Bolbitis longiflagellata, Bolbitis major, Bolbitis media, Bolbitis nicotianifolia, Bolbitis nodiflora, Bolbitis novoguineensis, Bolbitis oligarchica, Bolbitis palustris, Bolbitis pandurifolia, Bolbitis pergamentacea, Bolbitis portoricensis, Bolbitis presliana, Bolbitis quoyana, Bolbitis rawsonfi, Bolbitis repanda, Bolbitis rhizophylla, Bolbitis riparia, Bolbitis rivularis, Bolbitis sagenioides, Bolbitis salicina, Bolbitis scalpturata, Bolbitis scandens, Bolbitis semicordata, Bolbitis semipinnatifida, Bolbitis serrata, Bolbitis serratifolia, Bolbitis simplex, Bolbitis sinensis, Bolbitis singaporensis, Bolbitis sinuata, Bolbitis subcordata, Bolbitis subcrenata, Bolbitis taylorii, Bolbitis tibetica, Bolbitis tonkinensis, Bolbitis umbrosa, Bolbitis vanuaensis,* and *Bolbitis virens.*

In some embodiments the PtIP-50 polypeptide is derived from a fern species in the Order Polypodiales, Family Lomariopsidaceae, Genus *Nephrolepis.*

In some embodiments the PtIP-50 polypeptide is derived from a fern species in the Order Polypodiales, Family Lomariopsidaceae, Genus *Nephrolepis* selected from but not limited to *Nephrolepis abrupta, Nephrolepis acuminata, Nephrolepis acutifolia, Nephrolepis arida, Nephrolepis arthropteroides, Nephrolepis biserrata* var. *auriculata, Nephrolepis brownii, Nephrolepis celebica, Nephrolepis clementis, Nephrolepis cordifolia, Nephrolepis davalliae, Nephrolepis davallioides, Nephrolepis dayakorum, Nephrolepis delicatula, Nephrolepis dicksonioides, Nephrolepis duffii, Nephrolepis exaltata* ssp. *exaltata* ssp. *Hawaiiensis, Nephrolepis falcata, Nephrolepis falciformis, Nephrolepis glabra, Nephrolepis hirsutula, Nephrolepis humatoides, Nephrolepis iridescens, Nephrolepis kurotawae, Nephrolepis laurifolia, Nephrolepis lauterbachii, Nephrolepis lindsayae, Nephrolepis multifida, Nephrolepis multiflora, Nephrolepis niphoboloides, Nephrolepis obliterate, Nephrolepis paludosa, Nephrolepis pectinata, Nephrolepis pendula, Nephrolepis persicifolia, Nephrolepis pickelii, Nephrolepis pilosula, Nephrolepis pubescens, Nephrolepis pumicicola, Nephrolepis radicans, Nephrolepis rivularis, Nephrolepis rosenstockii, Nephrolepis saligna, Nephrolepis schlechteri, Nephrolepis serrate, Nephrolepis thomsoni, Nephrolepis undulate* var. *aureoglandulosa, Nephrolepis×averyi, Nephrolepis×copelandii,* and *Nephrolepis×medlerae.*

In some embodiments the PtIP-50 polypeptide is derived from a fern species in the Order Polypodiales, Family Polypodiaceae, Genus *Campyloneurum,* Genus *Drynaria,* Genus *Lepisorus,* Genus *Micrograma,* Genus *Microsorum,* Genus *Neurodium,* Genus *Niphidium,* Genus *Pecluma* M.G., Genus *Phlebodium,* Genus *Phymatosorus,* Genus *Platycerium,* Genus *Pleopeltis,* Genus *Polypodium* L.

In some embodiments the PtIP-50 polypeptide is derived from a fern species in the Order Polypodiales, Family Polypodiaceae, Genus *Polypodium* L.

In some embodiments the PtIP-50 polypeptide is derived from a fern species in the Order Polypodiales, Family Polypodiaceae, Genus *Polypodium* L. selected from but not limited to *Polypodium absidatum, Polypodium acutifolium, Polypodium adiantiforme, Polypodium aequale, Polypodium affine, Polypodium albidopaleatum, Polypodium alcicorne, Polypodium alfarii, Polypodium alfredii, Polypodium alfredii* var. *curtii, Polypodium allosuroides, Polypodium alsophilicola, Polypodium amamianum, Polypodium amoenum, Polypodium amorphum, Polypodium anetioides, Polypodium anfractuosum, Polypodium anguinum, Polypodium angustifolium* f. *remotifolia, Polypodium angustifolium* var. *amphostenon, Polypodium angustifolium* var. *heterolepis, Polypodium angustifolium* var. *monstrosa, Polypodium angustipaleatum, Polypodium angustissimum, Polypodium anisomeron* var. *pectinatum, Polypodium antioquianum, Polypodium aoristisorum, Polypodium apagolepis, Polypodium apicidens, Polypodium apiculatum, Polypodium apoense, Polypodium appalachianum, Polypodium appressum, Polypodium arenarium, Polypodium argentinurn, Polypodium argutum, Polypodium armaturn, Polypodium aromaticum, Polypodium aspersum, Polypodium assurgens, Polypodium atrum, Polypodium auriculaturn, Polypodium balaonense, Polypodium balliviani, Polypodium bamleri, Polypodium bangii, Polypodium bartlettii, Polypodium basale, Polypodium bemoullii, Polypodium biauritum, Polypodium bifrons, Polypodium blepharodes, Polypodium bolivari, Polypodium bolivianurn, Polypodium bolobense, Polypodium bombycinum, Polypodium bombycinum* var. *insularum, Polypodium bradeorum, Polypodium biyophilum, Polypodium btyopodum, Polypodium buchtienii, Polypodium buesii, Polypodium bulbotrichum, Polypodium caceresii, Polypodium califomicum* f. *brauscombii, Polypodium califomicum* f. *parsonsiae, Polypodium califomicum, Polypodium calophlebium, Polypodium calvum, Polypodium camptophyllarium* var. *abbreviatum, Polypodium capitellatum, Polypodium carpinterae, Polypodium chachapoyense, Polypodium chartaceum, Polypodium chimantense, Polypodium chiricanum, Polypodium choquetangense, Polypodium christensenii, Polypodium christii, Polypodium chrysotrichum, Polypodium ciliolepis, Polypodium cinerascens, Polypodium collinsii, Polypodium colysoides, Polypodium confluens, Polypodium conforme, Polypodium confusum, Polypodium congregatifolium, Polypodium connellii, Polypodium consimile* var. *bourgaeanum, Polypodium consimile* var. *minor, Polypodium conterminans, Polypodium contiguum, Polypodium cookii, Polypodium coriaceum, Polypodium coronans, Polypodium costaricense, Polypodium costatum, Polypodium crassifolium* f. *angustissimum, Polypodium crassifolium* var. *longipes, Polypodium crassulum, Polypodium craterisorum, Polypodium cryptum, Polypodium crystalloneuron, Polypodium cucullatum* var. *planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeraranum, Polypodium denticulatum, Polypodium diaphanum, Polypodium dilataturn, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis* var. *villosum, Polypodium exornans, Polypodium falcoideum, Polypodium fallacissimum, Polypodium farinosum, Polypodium faucium, Polypodium feet Polypodium ferrugineum, Polypodium feuillei, Polypodium firmulum, Polypodium firmum, Polypodium flaccidum, Polypodium flagellare, Polypodium flexuosum, Polypodium flexuosum* var. *ekmanii, Polypodium forbesii, Polypodium formosanum, Polypodium fraxinifolium* subsp. *articulatum, Polypodium fraxinifolium* subsp. *luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium*

*grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum* var. *simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens* var. *subdentatum, Polypodium insidiosum, Polypodium insigne, Polypodium intermedium* subsp. *masafueranum* var. *obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri* var. *costaricense, Polypodium lachniferum* f. *incurvata, Polypodium lachniferum* var. *glabrescens, Polypodium lachnopus, Polypodium lanceolatum* var. *cornplanatum, Polypodium lanceolatum* var. *trichophorum, Polypodium latevagans, Polypodium laxifrons, Polypodium laxifrons* var. *lividum, Polypodium lehmannieanum, Polypodium leiorhizum, Polypodium leptopodon, Polypodium leuconeuron* var. *angustifolia, Polypodium leuconeuron* var. *latifolium, Polypodium leucosticta, Polypodium limulum, Polypodium lindigii, Polypodium lineatum, Polypodium lomarioides, Polypodium longifrons, Polypodium loretense, Polypodium loriceum* var. *umbraticum, Polypodium loriforme, Polypodium loxogramme* f. *gigas, Polypodium ludens, Polypodium luzonicum, Polypodium lycopodioides* f. *obtusum, Polypodium lycopodioides* L., *Polypodium macrolepis, Polypodium macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalolepis, Polypodium melanotrichum, Polypodium menisciifolium* var. *pubescens, Polypodium meniscioides, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme* var. *minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum* var. *latior, Polypodium nubrigenum, Polypodium oligolepis, Polypodium oligosorum, Polypodium oligosorum, Polypodium olivaceum, Polypodium olivaceum* var. *elatum, Polypodium oodes, Polypodium oosphaerum, Polypodium oreophilum, Polypodium ornatissimum, Polypodium ornatum, Polypodium ovatum, Polypodium oxylobum, Polypodium oxypholis, Polypodium pakkaense, Polypodium pallidum, Polypodium palmatopedatum, Polypodium palmeri, Polypodium panamense, Polypodium parvum, Polypodium patagonicum, Polypodium paucisorum, Polypodium pavonianum, Polypodium pectinatum* var. *caliense, Polypodium pectinatum* var. *hispidum, Polypodium pellucidum, Polypodium pendulum* var. *boliviense, Polypodium percrassum, Polypodium perpusillum, Polypodium peruvianum* var. *subgibbosum, Polypodium phyllitidis* var. *elongatum, Polypodium pichinchense, Polypodium pilosissimum, Polypodium pilosissimum* var. *glabriusculum, Polypodium pilossimum* var. *tunguraquensis, Polypodium pityrolepis, Polypodium platyphyllum, Polypodium playfairii, Polypodium plebeium* var. *cooperi, Polypodium plectolepidioides, Polypodium pleolepis, Polypodium plesiosorum* var.i, *Polypodium podobasis, Polypodium podocarpum, Polypodium poloense, Polypodium polydatylon, Polypodium polypodioides* var. *aciculare, Polypodium polypodioides* var. *michauxianum, Polypodium praetermissum, Polypodium preslianum* var. *immersum, Polypodium procerum, Polypodium procerum, Polypodium productum, Polypodium productum, Polypodium prolongilobum, Polypodium propinguum, Polypodium proteus, Polypodium pruinatum, Polypodium pseudocapillare, Polypodium pseudofratemum, Polypodium pseudonutans, Polypodium pseudoserratum, Polypodium pulcherrimum, Polypodium pulogense, Polypodium pungens, Polypodium purpusii, Polypodium radicale, Polypodium randallii, Polypodium ratiborii, Polypodium reclinaturn, Polypodium recreense, Polypodium repens* var. *abruptum, Polypodium revolvens, Polypodium rhachipterygium, Polypodium rhomboideum, Polypodium rigens, Polypodium robustum, Polypodium roraimense, Polypodium roraimense, Polypodium rosei, Polypodium rosenstockii, Polypodium rubidum, Polypodium rudimentum, Polypodium rusbyi, Polypodium sablanianum, Polypodium sarmentosum, Polypodium saxicola, Polypodium schenckii, Polypodium schlechteri, Polypodium scolopendria, Polypodium scolopendria, Polypodium scolopendrium, Polypodium scouleri, Polypodium scutulatum, Polypodium segregatum, Polypodium semihirsutum, Polypodium semihirsutum* var. *fuscosetosum, Polypodium senile* var. *minor, Polypodium sericeolanatum, Polypodium serraeforme, Polypodium serricula, Polypodium sesquipedala, Polypodium sessilifolium, Polypodium setosum* var. *calvum, Polypodium setulosum, Polypodium shaferi, Polypodium sibomense, Polypodium siccum, Polypodium simacense, Polypodium simulans, Polypodium singeri, Polypodium sinicum, Polypodium sintenisii, Polypodium skutchii, Polypodium sloanei, Polypodium sodiroi, Polypodium sordidulum, Polypodium sordidum, Polypodium sphaeropteroides, Polypodium sphenodes, Polypodium sprucei, Polypodium sprucei* var. *furcativenosa, Polypodium steirolepis, Polypodium stenobasis, Polypodium stenolepis, Polypodium stenopterum, Polypodium subcapillare, Polypodium subflabelliforme, Polypodium subhemionitidium, Polypodium subinaequale, Polypodium subintegrum, Polypodium subspathulatum, Polypodium subtile, Polypodium subvestitum, Polypodium subviride, Polypodium superficiale* var. *attenuatum, Polypodium superficiale* var. *chinensis, Polypodium sursumcurrens, Polypodium tablazianurn, Polypodium taenifolium, Polypodium tamandarei, Polypodium tatei, Polypodium tenuiculum* var. *acrosora, Polypodium tenuiculum* var. *brasiliense, Polypodium tenuilore, Polypodium tenuinerve, Polypodium tepuiense, Polypodium teresae, Polypodium tetragonum* var. *incompletum, Polypodium thysanolepis* var. *bipinnatifidum, Polypodium thyssanolepis,* var. *thyssanolepis, Polypodium thyssanolepsi, Polypodium tobagense, Polypodium trichophyllum, Polypodium tridactylum, Polypodium tridentatum, Polypodium trifurcaturn* var. *brevipes, Polypodium triglossum, Polypodium truncatulum, Polypodium truncicola* var. *major, Polypodium truncicola* var. *minor, Polypodium tuberosum, Polypodium tunguraguae, Polypodium turquinurn, Polypodium turrialbae, Polypodium ursipes, Polypodium vagans, Polypodium valdealaturn, Polypodium versteegii, Polypodium villagranii,*

*Polypodium virginianum* f. *cambroideum, Polypodium virginianurn* f. *peraferens, Polypodium vittarioides, Polypodium vulgare, Polypodium vulgare* L., *Polypodium vulgare* subsp. *oreophilum, Polypodium vulgare* var. *acuminatum, Polypodium vulpinum, Polypodium williamsii, Polypodium wobbense, Polypodium×fallacissimum-guttatum, Polypodium xantholepis, Polypodium xiphopteris, Polypodium yarumalense, Polypodium yungense,* and *Polypodium zosteriforme.*

In some embodiments the PtIP-50 polypeptide is derived from a fern species in the Order Polypodiales, Family Polypodiaceae, Genus *Platycerium*. In some embodiments the PtIP-50 polypeptide is derived from a fern species in the Order Polypodiales, Family Polypodiaceae, Genus *Platycerium* selected from but not limited to *Platycerium alcicorne, Platycerium andinum, Platycerium angolense, Platycerium bifurcatum, Platycerium coronarium, Platycerium elephantotis, Platycerium ellisfi, Platycerium grande, Platycerium hillii, Platycerium holttumfi, Platycerium madagascariense, Platycerium quadridichotomum, Platycerium ridleyi, Platycerium* sp. ES-2011*, Platycerium stemaria, Platycerium superbum, Platycerium veitchii, Platycerium wallichii, Platycerium wandae, Platycerium wilhelminae-reginae,* and *Platycerium willinckii.*

In some embodiments the PtIP-50 polypeptide is derived from a species in the Division Lycophyta.

In some embodiments the PtIP-50 polypeptide is derived from a species in the Class Isoetopsida or Class Lycopodiopsida.

In some embodiments the PtIP-50 polypeptide is derived from a species in the Class Isoetopsida Order Selaginales. In some embodiments the PtIP-50 polypeptide is derived from a fern species in the Class Isoetopsida, Order Selaginales, Family Selaginellaceae. In some embodiments the PtIP-50 polypeptide is derived from a species in the Genus *Selaginella*. In some embodiments the PtIP-50 polypeptide is derived from a *Selaginella* species selected from but not limited to *Selaginella acanthonota, Selaginella apoda, Selaginella arbuscula, Selaginella arenicola, Selaginella arizonica, Selaginella armata, Selaginella asprella, Selaginella biformis, Selaginella bigelovii, Selaginella braunii, Selaginella cinerascens, Selaginella cordifolia, Selaginella deflexa, Selaginella delicatula, Selaginella densa, Selaginella douglasii, Selaginella eatonii, Selaginella eclipes, Selaginella eremophila, Selaginella erythropus, Selaginella flabellata, Selaginella hansenii, Selaginella heterodonta, Selaginella kraussiana, Selaginella krugii, Selaginella laxifolia, Selaginella lepidophylla, Selaginella leucobryoides, Selaginella ludoviciana, Selaginella mutica, Selaginella oregana, Selaginella ovifolia, Selaginella pallescens, Selaginella peruviana, Selaginella pilifera, Selaginella plana, Selaginella plumosa, Selaginella pulcherrima, Selaginella rupestris, Selaginella rupincola, Selaginella scopulorum, Selaginella selaginoides, Selaginella sibirica, Selaginella standleyi, Selaginella stellata, Selaginella subcaulescens, Selaginella substipitata, Selaginella tenella, Selaginella tortipila, Selaginella uliginosa, Selaginella umbrosa, Selaginella uncinata, Selaginella underwoodii, Selaginella utahensis, Selaginella victoriae, Selaginella viridissima, Selaginella wallacei, Selaginella watsonii, Selaginella weatherbiana, Selaginella willdenowii, Selaginella wrightii* and *Selaginella×neomexicana.*

In some embodiments the PtIP-50 polypeptide is derived from a species in the Class Lycopodiopsida, Order Lycopodiales.

In some embodiments the PtIP-50 polypeptide is derived from a fern species in the Class Lycopodiopsida, Order Lycopodiales Family Lycopodiaceae or Family Huperziaceae.

In some embodiments the PtIP-50 polypeptide is derived from a species in the Genus *Austrolycopodium, Dendrolycopodium, Diphasiastrum, Diphasium, Huperzia, Lateristachys, Lycopodiastrum, Lycopodiella, Lycopodium, Palhinhaea, Pseudodiphasium, Pseudolycopodiella, Pseudolycopodium* or *Spinulum*.

In some embodiments the PtIP-50 polypeptide is derived from a species in the Genus *Lycopodium*.

In some embodiments the PtIP-50 polypeptide is derived from a *Lycopodium* species selected from but not limited to *Lycopodium alpinum* L., *Lycopodium annotinum* L., *Lycopodium clavatum* L., *Lycopodium cornplanatum* L., *Lycopodium dendroideum* Michx., *Lycopodium digitatum, Lycopodium xhabereri, Lycopodium hickeyi, Lycopodium×issleri, Lycopodium lagopus, Lycopodium obscurum* L., *Lycopodium phlegmaria* L., *Lycopodium sabinifolium, Lycopodium sitchense, Lycopodium tristachyum, Lycopodium venustulum, Lycopodium venustulum* var. *venustulum, Lycopodium venustulum* var. *verticale, Lycopodium volubile* and *Lycopodium×zeilleri.*

In some embodiments the PtIP-50 polypeptide is derived from a species in the Genus *Huperzia*. In some embodiments the PtIP-50 polypeptide is derived from a species selected from but not limited to *Huperzia appressa, Huperzia arctica, Huperzia attenuata, Huperzia australiana, Huperzia balansae, Huperzia billardierei, Huperzia brassii, Huperzia campiana, Huperzia capellae, Huperzia carinata, Huperzia* cf. *carinata* ARF000603, *Huperzia* cf. *nummulariifolia* ARF001140, *Huperzia* cf. *phlegmaria* ARF000717, *Huperzia* cf. *phlegmaria* ARF000771, *Huperzia* cf. *phlegmaria* ARF000785, *Huperzia* cf. *phlegmaria* ARF001007, *Huperzia* cf. *phlegmaria* ARF002568, *Huperzia* cf. *phlegmaria* ARF002703, *Huperzia* cf. *phlegmaria* Wikstrom 1998, *Huperzia chinensis, Huperzia compacta, Huperzia crassa, Huperzia crispata, Huperzia cryptomeriana, Huperzia cumingii, Huperzia dacrydioides, Huperzia dalhousieana, Huperzia dichotoma, Huperzia emeiensis, Huperzia ericifolia, Huperzia eversa, Huperzia fargesii, Huperzia fordii, Huperzia funiformis, Huperzia goebellii, Huperzia haleakalae, Huperzia hamiltonii, Huperzia heteroclita, Huperzia hippuridea, Huperzia hippuris, Huperzia holstii, Huperzia horizontalis, Huperzia hunanensis, Huperzia hystrix, Huperzia lindenii, Huperzia linifolia, Huperzia lockyeri, Huperzia lucidula, Huperzia mingcheensis, Huperzia miyoshiana, Huperzia nanchuanensis, Huperzia nummulariifolia, Huperzia obtusifolia, Huperzia ophioglossoides, Huperzia petiolata, Huperzia phlegmaria, Huperzia phlegmarioides, Huperzia phyllantha, Huperzia pinifolia, Huperzia polydactyla, Huperzia prolifera, Huperzia reflexa, Huperzia rosenstockiana, Huperzia rufescens, Huperzia salvinoides, Huperzia sarmentosa, Huperzia selago, Huperzia serrata, Huperzia sieboldii, Huperzia somae, Huperzia squarrosa, Huperzia subulata, Huperzia sutchueniana, Huperzia tauri, Huperzia taxifolia, Huperzia tenuis, Huperzia tetragona, Huperzia tetrasticha, Huperzia unguiculata, Huperzia varia, Huperzia verticillata* and *Huperzia wilsonii.*

Phylogenetic, Sequence Motif, and Structural Analyses for Insecticidal Protein Families The sequence and structure analysis method employed is composed of four components: phylogenetic tree construction, protein sequence motifs finding, secondary structure prediction, and alignment of protein sequences and secondary structures. Details about each component are illustrated below.

1) Phylogenetic Tree Construction

The phylogenetic analysis was performed using the software MEGA5. Protein sequences were subjected to ClustalW version 2 analysis (Larkin M. A et al (2007) *Bioinformatics* 23(21): 2947-2948) for multiple sequence alignment. The evolutionary history was then inferred by the Maximum Likelihood method based on the JTT matrix-based model. The tree with the highest log likelihood was obtained, exported in Newick format, and further processed to extract the sequence IDs in the same order as they appeared in the tree. A few clades representing sub-families were manually identified for each insecticidal protein family.

2) Protein Sequence Motifs Finding

Protein sequences were re-ordered according to the phylogenetic tree built previously, and fed to the motif analysis tool MEME (Multiple EM for motif Elicitation) (Bailey T. L., and Elkan C., *Proceedings of the Second International Conference on Intelligent Systems for Molecular Biology*, pp. 28-36, AAAI Press, Menlo Park, Calif., 1994) for identification of key sequence motifs. MEME was setup as follows: Minimum number of sites 2, Minimum motif width 5, and Maximum number of motifs 50. Sequence motifs unique to each sub-family were identified by visual observation. The distribution of motifs across the entire gene family could be visualized in HTML webpage. The motifs are numbered relative to the ranking of the E-value for each motif. The amino acid sequence motifs identified for each of the PtIP-50 polypeptides and the residue ranges defining the motifs relative to each of the corresponding sequence identifier (SEQ ID NO:) are shown in Table 2. An amino acid sequence motif not identified in a particular PtIP-50 polypeptide is indicated in Table 2 as "n. i.". The amino acid sequence motifs identified for each of the PtIP-65 polypeptides and the residue ranges defining the motifs relative to the corresponding sequence identifier (SEQ ID NO:) are shown in Table 3. An amino acid sequence motif not identified in a particular PtIP-65 polypeptide is indicated in Table 3 as "n. i.". FIG. 16a-16u shows an alignment of the PtIP-50 polypeptides PtIP-50Aa (SEQ ID NO: 71), PtIP-50Ba (SEQ ID NO: 77), PtIP-50Bb (SEQ ID NO: 84), PtIP-50Bc (SEQ ID NO: 78), PtIP-50Bd (SEQ ID NO: 96), PtIP-50Fa (SEQ ID NO: 86), PtIP-50Fb (SEQ ID NO: 72), PtIP-50Fd (SEQ ID NO: 87), PtIP-50Fe (SEQ ID NO: 79), PtIP-50Ff (SEQ ID NO: 83), PtIP-50Fg (SEQ ID NO: 82), PtIP-50Fh (SEQ ID NO: 81), PtIP-50Fi (SEQ ID NO: 90), PtIP-50Fj (SEQ ID NO: 91), PtIP-50Fk (SEQ ID NO: 89), PtIP-50Fl (SEQ ID NO: 94), PtIP-50Fm (SEQ ID NO: 98), PtIP-50Fn (SEQ ID NO: 93), PtIP-50Fo (SEQ ID NO: 73), PtIP-50Fp (SEQ ID NO: 97), PtIP-50Fq (SEQ ID NO: 95), PtIP-50Fr (SEQ ID NO: 75), PtIP-50Fs (SEQ ID NO: 74), PtIP-50Ft (SEQ ID NO: 85), PtIP-50Ga (SEQ ID NO: 88), PtIP-50Gb (SEQ ID NO: 80, PtIP-50Gc (SEQ ID NO: 76), and PtIP-50Gd (SEQ ID NO: 92)], and the location, relative to PtIP-50Fb (SEQ ID NO: 72), of the amino acid sequence motifs present in PtIP-50Fb (SEQ ID NO: 72). FIGS. 17a-17k shows an alignment of the amino acid sequences of PtIP-65Aa (SEQ ID NO: 22), PtIP-65Ba (SEQ ID NO: 24), PtIP-65Bb (SEQ ID NO: 26), PtIP-65Ca (SEQ ID NO: 29), PtIP-65Fa (SEQ ID NO: 41), PtIP-65Fb (SEQ ID NO: 42), PtIP-65Ga (SEQ ID NO: 30), PtIP-65Gb (SEQ ID NO: 34), PtIP-65Gc (SEQ ID NO: 27), PtIP-65Gd (SEQ ID NO: 35), PtIP-65Ge (SEQ ID NO: 36), PtIP-65Ha (SEQ ID NO: 25), PtIP-65Hb (SEQ ID NO: 31), PtIP-65Hc (SEQ ID NO: 23), PtIP-65Hd (SEQ ID NO: 28), PtIP-65He (SEQ ID NO: 32), PtIP-65Hf (SEQ ID NO: 33), PtIP-65Hg (SEQ ID NO: 40), PtIP-65Hh (SEQ ID NO: 38), PtIP-65Hj (SEQ ID NO: 39), and PtIP-65Hk (SEQ ID NO: 37); and the location, relative to PtIP-65Gc (SEQ ID NO: 27), of the amino acid sequence motifs present in PtIP-65Gc (SEQ ID NO: 72).

3) Secondary Structure Prediction

PSIPRED, top ranked secondary structure prediction method (Jones D T. (1999) *J. Mol. Biol.* 292: 195-202), was installed in local Linux server, and used for protein secondary structure prediction. The tool provides accurate structure prediction using two feed-forward neural networks based on the PSI-BLAST output. The PSI-BLAST database was created by removing low-complexity, transmembrane, and coiled-coil regions in Uniref100. The PSIPRED results contain the PtIP-secondary structures (Alpha helix: H, *Beta* strand: E, and Coil: C) and the corresponding confidence scores for each amino acid in a given protein sequence. FIG. 16 shows the PtIP-50 polypeptide amino acid sequence alignments and the conserved secondary structural regions. FIG. 17 shows the PtIP-65 polypeptide amino acid sequence alignments and conserved secondary structural regions.

4) Alignment of Protein Sequences and Secondary Structures

A customized script was developed to generate gapped secondary structure alignment according to the multiple protein sequence alignment from step 1 for all proteins. All aligned protein sequences and structures were concatenated into a single FASTA file, and then imported into MEGA for visualization and identification of conserved structures. The file was also edited in GeneDoc to produce acceptable sequence format for patent offices.

In some embodiments the PtIP-50 polypeptide comprises at least one amino acid sequence motif as shown in Table 2.

TABLE 2

|  |  | Motif 23 | Motif 8 | Motif 16 | Motif 18 | Motif 14 | Motif 19 |
| --- | --- | --- | --- | --- | --- | --- | --- |
| PtIP-50Aa | SEQ ID NO: 71 | 5-16 | 17-44 | 49-70 | 71-91 | 196-226 | 231-252 |
| PtIP-50Ba | SEQ ID NO: 77 | 5-16 | 17-44 | 49-70 | 71-91 | 196-226 | 231-252 |
| PtIP-50Bb | SEQ ID NO: 84 | 5-16 | 17-44 | 49-70 | 71-91 | 195-225 | 230-251 |
| PtIP-50Bc | SEQ ID NO: 78 | 5-16 | 17-44 | 49-70 | 71-91 | 195-225 | 230-251 |
| PtIP-50Bd | SEQ ID NO: 96 | 5-16 | 17-44 | 49-70 | 71-91 | 195-225 | 230-251 |
| PtIP-50Fa | SEQ ID NO: 86 | 2-13 | 14-41 | 48-69 | 73-93 | 253-283 | 289-310 |
| PtIP-50Fb | SEQ ID NO: 72 | 7-18 | 21-48 | 49-70 | 73-93 | 235-265 | 270-291 |
| PtIP-50Fd | SEQ ID NO: 87 | 12-23 | 26-53 | 54-75 | 86-106 | 277-307 | 312-333 |
| PtIP-50Fe | SEQ ID NO: 79 | 7-18 | 21-48 | 49-70 | 73-93 | 233-263 | 268-289 |
| PtIP-50Ff | SEQ ID NO: 83 | 2-13 | 14-41 | 42-63 | 70-90 | 264-294 | 299-320 |
| PtIP-50Fg | SEQ ID NO: 82 | 11-22 | 25-52 | 53-74 | 76-96 | 288-318 | 323-344 |
| PtIP-50Fh | SEQ ID NO: 81 | 11-22 | 25-52 | 53-74 | 82-102 | 285-315 | 320-341 |
| PtIP-50Fi | SEQ ID NO: 90 | 2-13 | 14-41 | n.i. | 63-83 | 237-267 | 272-293 |
| PtIP-50Fj | SEQ ID NO: 91 | 2-13 | 14-41 | 48-69 | 72-92 | 262-292 | 297-318 |
| PtIP-50Fk | SEQ ID NO: 89 | 54-65 | 68-95 | 96-117 | 120-140 | 281-311 | 316-337 |

TABLE 2-continued

| | | | | | | | |
|---|---|---|---|---|---|---|---|
| PtIP-50Fl | SEQ ID NO: 94 | 7-18 | 21-48 | 49-70 | 73-93 | 234-264 | 269-290 |
| PtIP-50Fm | SEQ ID NO: 98 | 17-28 | 31-58 | 59-80 | 91-111 | 283-313 | 318-339 |
| PtIP-50Fn | SEQ ID NO: 93 | 7-18 | 21-48 | 49-70 | 73-93 | 236-266 | 271-292 |
| PtIP-50Fo | SEQ ID NO: 73 | 50-61 | 64-91 | 92-113 | 124-144 | 285-315 | 320-341 |
| PtIP-50Fp | SEQ ID NO: 97 | 6-17 | 18-45 | 46-67 | 68-88 | 223-253 | 259-280 |
| PtIP-50Fq | SEQ ID NO: 95 | n.i. | n.i. | 33-54 | 61-81 | 257-287 | 292-313 |
| PtIP-50Fr | SEQ ID NO: 75 | 11-22 | 25-52 | 53-74 | 85-105 | 278-308 | 313-334 |
| PtIP-50Fs | SEQ ID NO: 74 | 7-18 | 21-48 | 49-70 | 80-100 | 242-272 | 277-298 |
| PtIP-50Ft | SEQ ID NO: 85 | 7-18 | 21-48 | 49-70 | 79-99 | 265-295 | 300-321 |
| PtIP-50Ga | SEQ ID NO: 88 | 40-51 | 54-81 | 82-103 | 106-126 | 256-286 | 292-313 |
| PtIP-50Gb | SEQ ID NO: 80 | 39-50 | 53-80 | 81-102 | 105-125 | 256-286 | 292-313 |
| PtIP-50Gc | SEQ ID NO: 76 | 40-51 | 54-81 | 82-103 | 106-126 | 256-286 | 292-313 |
| PtIP-50Gd | SEQ ID NO: 92 | 41-52 | 55-82 | 83-104 | 107-127 | 258-288 | 294-315 |

| | | Motif 20 | Motif 13 | Motif 2 | motif 12 | Motif 11 | Motif 21 |
|---|---|---|---|---|---|---|---|
| PtIP-50Aa | SEQ ID NO: 71 | 255-270 | 273-294 | 295-337 | 342-377 | 385-410 | 412-427 |
| PtIP-50Ba | SEQ ID NO: 77 | 255-270 | 273-294 | 295-337 | 342-377 | 385-410 | 412-427 |
| PtIP-50Bb | SEQ ID NO: 84 | 254-269 | 272-293 | 294-336 | 341-376 | 384-409 | 411-426 |
| PtIP-50Bc | SEQ ID NO: 78 | 254-269 | 272-293 | 294-336 | 341-376 | 384-409 | 411-426 |
| PtIP-50Bd | SEQ ID NO: 96 | 254-269 | 272-293 | 294-336 | 341-376 | 384-409 | 411-426 |
| PtIP-50Fa | SEQ ID NO: 86 | 311-326 | 330-351 | 352-394 | 399-434 | 442-467 | 472-487 |
| PtIP-50Fb | SEQ ID NO: 72 | 298-313 | 318-339 | 340-382 | 387-422 | 430-455 | 457-472 |
| PtIP-50Fd | SEQ ID NO: 87 | 339-354 | 359-389 | 381-423 | 428-463 | 471-496 | 498-513 |
| PtIP-50Fe | SEQ ID NO: 79 | 296-311 | 316-337 | 338-380 | 385-420 | 428-453 | 455-470 |
| PtIP-50Ff | SEQ ID NO: 83 | 321-336 | 340-361 | 362-404 | 409-444 | 452-477 | 479-494 |
| PtIP-50Fg | SEQ ID NO: 82 | 350-365 | 370-391 | 392-434 | 439-474 | 482-507 | 509-524 |
| PtIP-50Fh | SEQ ID NO: 81 | 348-363 | 368-389 | 393-435 | 440-475 | 483-508 | 510-525 |
| PtIP-50Fi | SEQ ID NO: 90 | 297-312 | 316-337 | 338-380 | 385-420 | 428-453 | 455-470 |
| PtIP-50Fj | SEQ ID NO: 91 | 330-345 | 349-370 | 371-413 | 418-453 | 461-486 | 488-503 |
| PtIP-50Fk | SEQ ID NO: 89 | 344-359 | 364-385 | 386-428 | 433-468 | 476-501 | 503-518 |
| PtIP-50Fl | SEQ ID NO: 94 | 297-312 | 317-338 | 339-381 | 386-421 | 429-454 | 456-471 |
| PtIP-50Fm | SEQ ID NO: 98 | 345-360 | 365-386 | 387-429 | 434-469 | 477-502 | 504-519 |
| PtIP-50Fn | SEQ ID NO: 93 | 299-314 | 319-340 | 341-383 | 388-423 | 431-456 | 458-473 |
| PtIP-50Fo | SEQ ID NO: 73 | 348-363 | 368-389 | 390-432 | 437-472 | 480-50 | 507-522 |
| PtIP-50Fp | SEQ ID NO: 97 | 288-303 | 309-330 | 331-373 | 378-413 | 421-446 | n.i. |
| PtIP-50Fq | SEQ ID NO: 95 | 314-329 | 337-358 | 359-401 | 406-441 | 449-474 | 476-491 |
| PtIP-50Fr | SEQ ID NO: 75 | 340-355 | 360-381 | 382-424 | 429-464 | 473-498 | 500-515 |
| PtIP-50Fs | SEQ ID NO: 74 | 305-320 | 325-346 | 347-389 | 394-429 | 437-462 | 464-479 |
| PtIP-50Ft | SEQ ID NO: 85 | 329-344 | 350-371 | 372-414 | 419-454 | 462-487 | 489-504 |
| PtIP-50Ga | SEQ ID NO: 88 | 320-335 | 341-362 | 363-405 | 410-445 | 453-478 | n.i. |
| PtIP-50Gb | SEQ ID NO: 80 | 320-335 | 341-362 | 363-405 | 410-445 | 453-478 | n.i. |
| PtIP-50Gc | SEQ ID NO: 76 | 320-335 | 341-362 | 363-405 | 410-445 | 453-478 | n.i. |
| PtIP-50Gd | SEQ ID NO: 92 | 322-337 | 343-364 | 365-407 | 412-447 | 455-480 | n.i. |

| | | Motif 9 | Motif 6 | Motif 1 | Motif 4 | Motif 7 | Motif 22 |
|---|---|---|---|---|---|---|---|
| PtIP-50Aa | SEQ ID NO: 71 | 429-478 | 480-501 | 504-553 | 556-598 | 606-652 | 653-664 |
| PtIP-50Ba | SEQ ID NO: 77 | 429-478 | 480-501 | 504-553 | 556-598 | 606-652 | 653-664 |
| PtIP-50Bb | SEQ ID NO: 84 | 428-477 | 479-500 | 503-552 | 555-597 | 605-651 | 652-663 |
| PtIP-50Bc | SEQ ID NO: 78 | 428-477 | 479-500 | 503-552 | 555-597 | 605-651 | 652-663 |
| PtIP-50Bd | SEQ ID NO: 96 | 428-477 | 479-500 | 503-552 | 555-597 | 605-651 | 652-663 |
| PtIP-50Fa | SEQ ID NO: 86 | 489-538 | 540-561 | 564-613 | 616-658 | n.i. | 718-729 |
| PtIP-50Fb | SEQ ID NO: 72 | 474-523 | 525-546 | 549-598 | 601-643 | 651-697 | 698-709 |
| PtIP-50Fd | SEQ ID NO: 87 | 515-564 | 566-587 | 590-639 | 642-684 | 692-738 | 739-750 |
| PtIP-50Fe | SEQ ID NO: 79 | 472-521 | 523-544 | 547-596 | 599-641 | 649-695 | 696-707 |
| PtIP-50Ff | SEQ ID NO: 83 | 496-545 | 547-568 | 571-620 | 623-665 | 674-720 | 721-732 |
| PtIP-50Fg | SEQ ID NO: 82 | 526-575 | 577-598 | 601-650 | 653-695 | 703-749 | 750-761 |
| PtIP-50Fh | SEQ ID NO: 81 | 527-576 | 578-599 | 602-651 | 655-697 | 705-751 | 752-763 |
| PtIP-50Fi | SEQ ID NO: 90 | 472-521 | 523-544 | 548-597 | 600-642 | 651-697 | 698-709 |
| PtIP-50Fj | SEQ ID NO: 91 | 505-554 | 556-577 | 581-630 | 633-675 | 684-730 | 731-742 |
| PtIP-50Fk | SEQ ID NO: 89 | 520-569 | 571-592 | 595-644 | 647-689 | 697-743 | 744-755 |
| PtIP-50Fl | SEQ ID NO: 94 | 473-522 | 524-545 | 548-597 | 600-642 | 650-696 | 697-708 |
| PtIP-50Fm | SEQ ID NO: 98 | 521-570 | 572-593 | 596-645 | 648-690 | 698-744 | 745-756 |
| PtIP-50Fn | SEQ ID NO: 93 | 475-524 | 526-547 | 550-599 | 602-644 | 652-698 | 699-710 |
| PtIP-50Fo | SEQ ID NO: 73 | 524-573 | 575-596 | 599-648 | 651-693 | 701-747 | 748-759 |
| PtIP-50Fp | SEQ ID NO: 97 | 465-514 | 516-537 | 540-589 | 592-634 | 641-687 | 688-699 |
| PtIP-50Fq | SEQ ID NO: 95 | 493-542 | 544-565 | 568-617 | 620-662 | 671-717 | 718-729 |
| PtIP-50Fr | SEQ ID NO: 75 | 517-566 | 568-589 | 592-641 | 644-686 | 694-740 | 741-752 |
| PtIP-50Fs | SEQ ID NO: 74 | 481-530 | 532-553 | 556-605 | 608-650 | 658-704 | 705-716 |
| PtIP-50Ft | SEQ ID NO: 85 | 506-555 | 557-578 | 581-630 | 633-675 | 683-729 | 730-741 |
| PtIP-50Ga | SEQ ID NO: 88 | 504-553 | 554-575 | 578-627 | 631-673 | n.i. | 732-743 |
| PtIP-50Gb | SEQ ID NO: 80 | 504-553 | 554-575 | 578-627 | 631-673 | n.i. | 732-743 |
| PtIP-50Gc | SEQ ID NO: 76 | n.i. | 554-575 | 578-627 | 631-673 | n.i. | 732-743 |
| PtIP-50Gd | SEQ ID NO: 92 | n.i. | 556-577 | 580-629 | 633-675 | n.i. | 734-745 |

| | | Motif 10 | Motif 17 | Motif 3 | Motif 24 | Motif 5 | Motif 15 |
|---|---|---|---|---|---|---|---|
| PtIP-50Aa | SEQ ID NO: 71 | 665-686 | 690-705 | 709-746 | 749-757 | 758-779 | 781-802 |
| PtIP-50Ba | SEQ ID NO: 77 | 665-686 | 690-705 | 709-746 | 749-757 | 758-779 | 781-802 |

TABLE 2-continued

| | | | | | | | |
|---|---|---|---|---|---|---|---|
| PtIP-50Bb | SEQ ID NO: 84 | 664-685 | 691-706 | 710-747 | 750-758 | 759-780 | 782-803 |
| PtIP-50Bc | SEQ ID NO: 78 | 664-685 | 689-704 | 708-745 | 748-756 | 757-778 | 780-801 |
| PtIP-50Bd | SEQ ID NO: 96 | 664-685 | 689-704 | 708-745 | 748-756 | 757-778 | 780-801 |
| PtIP-50Fa | SEQ ID NO: 86 | 731-752 | 763-778 | 780-817 | 820-828 | 829-850 | 853-874 |
| PtIP-50Fb | SEQ ID NO: 72 | 711-732 | 747-762 | 764-801 | 804-812 | 813-834 | 837-858 |
| PtIP-50Fd | SEQ ID NO: 87 | 752-773 | 784-799 | 801-838 | 841-849 | 850-871 | 873-894 |
| PtIP-50Fe | SEQ ID NO: 79 | 709-730 | 740-755 | 757-794 | 797-805 | 806-828 | 830-851 |
| PtIP-50Ff | SEQ ID NO: 83 | 734-755 | 766-781 | 783-820 | 823-831 | 832-853 | 855-876 |
| PtIP-50Fg | SEQ ID NO: 82 | 763-784 | 789-804 | 806-843 | 846-854 | 855-876 | 878-899 |
| PtIP-50Fh | SEQ ID NO: 81 | 765-786 | 794-809 | 811-848 | 851-859 | 860-881 | 883-904 |
| PtIP-50Fi | SEQ ID NO: 90 | 712-733 | 743-758 | 760-797 | 800-808 | 809-830 | 832-853 |
| PtIP-50Fj | SEQ ID NO: 91 | 744-765 | 775-790 | 792-829 | 832-840 | 842-863 | 865-886 |
| PtIP-50Fk | SEQ ID NO: 89 | 757-778 | 792-807 | 809-846 | 849-857 | 858-879 | 882-903 |
| PtIP-50Fl | SEQ ID NO: 94 | 710-731 | 742-757 | 759-796 | 799-807 | 808-829 | 832-853 |
| PtIP-50Fm | SEQ ID NO: 98 | 758-779 | 786-801 | 803-840 | 843-851 | 852-873 | 875-896 |
| PtIP-50Fn | SEQ ID NO: 93 | 712-733 | 744-759 | 761-798 | 801-809 | 810-831 | 834-855 |
| PtIP-50Fo | SEQ ID NO: 73 | 761-782 | 791-806 | 808-845 | 848-856 | 857-878 | 881-902 |
| PtIP-50Fp | SEQ ID NO: 97 | 701-722 | 727-742 | 744-781 | 784-792 | 793-814 | 819-839 |
| PtIP-50Fq | SEQ ID NO: 95 | 731-752 | 763-778 | 780-817 | 820-828 | 830-851 | 853-874 |
| PtIP-50Fr | SEQ ID NO: 75 | 754-775 | 789-804 | 806-843 | 846-854 | 855-876 | 879-900 |
| PtIP-50Fs | SEQ ID NO: 74 | 718-739 | 752-767 | 769-806 | 809-817 | 818-839 | 842-863 |
| PtIP-50Ft | SEQ ID NO: 85 | 743-764 | 769-784 | 786-823 | 826-834 | 835-856 | 858-879 |
| PtIP-50Ga | SEQ ID NO: 88 | 746-767 | 769-784 | 786-823 | 824-832 | 833-854 | 860-881 |
| PtIP-50Gb | SEQ ID NO: 80 | 746-767 | 769-784 | 786-823 | 824-832 | 833-854 | 859-880 |
| PtIP-50Gc | SEQ ID NO: 76 | 746-767 | 769-784 | 786-823 | 824-832 | 833-854 | 860-881 |
| PtIP-50Gd | SEQ ID NO: 92 | 748-769 | 771-786 | 788-825 | 826-834 | 835-856 | 858-879 |

In some embodiments the PtIP-50 polypeptide comprises at least one amino acid sequence motif selected from: an amino acid sequence motif 1 as represented by an amino acid sequence of the formula AWK[AT][KS]C[KR]NVA[AV][LV]G[RQ]E[ML][CTS]TTAA[YH]I[SA][EQ]LQY[DEQ]I[QK]VQ[AE]MLQ[EDQ]IA[RQ][KR]QA[DE]RL[SE][SGA]I (SEQ ID NO: 123); an amino acid sequence motif 2 as represented by an amino acid sequence of the formula [EQ][SA]YDQ[ESD][LF][KR]Q[LF][KQ]LF[IV][AQ]QN[KE]ILG[SG]YLL[EQ]QN[RK]AFA[EA][KR]E[RK]DM[ED][VA]FHS (SEQ ID NO: 124); an amino acid sequence motif 3 as represented by an amino acid sequence of the formula F[HR]DRN[EK][TASGERDN]E[VP]L[HE]YEA[AG][TV][PG]L[DV]Y[HQ]YAY[NR]LDTG[EA]TT[LV][TS]NLPS (SEQ ID NO: 125); an amino acid sequence motif 4 as represented by an amino acid sequence of the formula ADL[ST][SN][YF]TE[ML][VA][TS][QE]MDM-RTTR[LM]L[LV][EA]LIKVL[HNY][IM]QN[AGV]ALM Y[QE]YLS[EP][PA] (SEQ ID NO: 126); an amino acid sequence motif 5 as represented by an amino acid sequence of the formula PFT[RNT]WRLR[LV]SASA[EQ]EN[EKQ] GLAFP (SEQ ID NO: 127); an amino acid sequence motif 6 as represented by an amino acid sequence of the formula DW[LD]IF[VE]NE[VI]E[AG]VA[EA]QMP[TE]EVSE (SEQ ID NO: 128); an amino acid sequence motif 7 as represented by an amino acid sequence of the formula V[TN]M[EDQ]TVW[GR][ML]L[VI]Q[HQ]E[HQ]AA[IV][LQ]GL[LM][RQ]LG[PA][SAP][FS]D[FI][T RV]RT[YF]VVKDIPV[DS]LLL[DH]G (SEQ ID NO: 129); an amino acid sequence motif 8 as represented by an amino acid sequence of the formula IRLD[QK]MEFSEVM[VA][IV]HRM[FH][IVF][RK][LM][DP][DE]LD[IVL][AG][HL] (SEQ ID NO: 130); an amino acid sequence motif 9 as represented by an amino acid sequence of the formula [AL]A[RE][GK]L[QKE][RK]V[LV][EQ]IL[ED][GD]LQA[VA]MEVV[AK][AI]I[KN][DE]LVESLQE[LI V]GQLV[DE]AP[ED]MP[DE][ML]P[TS]E (SEQ ID NO: 131); an amino acid sequence motif 10 as represented by an amino acid sequence of the formula [TV]FP[LS][TS][WL]SRVRI[HR][HY][LV]EMKF[VD][GQA][AG]A (SEQ ID NO: 132); an amino acid sequence motif 11 as represented by an amino acid sequence of the formula [RK]Q[VL]A[RN]A[LV]FAV[LF][GR]AI[AG][AS][VI][AG]L[AT][FVL][ALV]TGGA (SEQ ID NO: 133); an amino acid sequence motif 12 as represented by an amino acid sequence of the formula [QL][RK][QRT][STI]EL[DQ]N[TA][IML][QE][KR][MI]DQLSLQMET[QE]S[AE][DA]M[ED]QA[KQ R][AE]DM[ED][AE] (SEQ ID NO: 134); an amino acid sequence motif 13 as represented by an amino acid sequence of the formula LVVP[QR]LQY[DH]MYSNLI[ND][RQ][ML][AV][QR]VA (SEQ ID NO: 135); an amino acid sequence motif 14 as represented by an amino acid sequence of the formula [PA][DV]A[LV]LTDP[NS][IV][LI][LS][GC]MQT[ST][ML]LIAELV[EL][FV][AS][HQ][PN]SS (SEQ ID NO: 136); an amino acid sequence motif 15 as represented by an amino acid sequence of the formula [AT][TV][SG]A[DG][AD]TTQIAITF[HYF][VI][ST]AIR[RQE]I (SEQ ID NO: 137); an amino acid sequence motif 16 as represented by an amino acid sequence of the formula LEGA[ED]KVKRLYVFADVVEL[PE][SG]K (SEQ ID NO: 138); an amino acid sequence motif 17 as represented by an amino acid sequence of the formula P[IV]TD[TS]GE[VI]Y[IM]LLQ[SG]SR (SEQ ID NO: 139); an amino acid sequence motif 18 as represented by an amino acid sequence of the formula T[VL][RS]LPG[ST][IV][MS]VVILCR[VI]L[HV][LV]N[GS] (SEQ ID NO: 140); an amino acid sequence motif 19 as represented by an amino acid sequence of the formula [AV]V[TR][KR]H[VA]EWLN[KT]LL[LV]Q[AV]SAAAQ[GS] (SEQ ID NO: 141); an amino acid sequence motif 20 as represented by an amino acid sequence of the formula [YV][LV]ALL[FY]R[AT]Q[YA][LVF][IL]K[LGM]V[GK] (SEQ ID NO: 142); an amino acid sequence motif 21 as represented by an amino acid sequence of the formula AP[GAL]A[VIM][AS]AA[KGR][GA]AV[ST][AI]AG (SEQ ID NO: 143); an amino acid sequence motif 22 as represented by an amino acid sequence of the formula [ED]D[WY][EQ]FE[IL]PVEDF (SEQ ID NO: 144); and an amino acid sequence motif 23 as represented by an amino acid sequence of the formula YS[EH]LYR[DE][LV]NQ[VI]S (SEQ ID NO: 145); and an amino acid sequence motif 24 as represented by an amino acid sequence of the formula F[AI][NR]TFMRMT (SEQ ID NO: 146).

In some embodiments the PtIP-50 polypeptide comprises at least one amino acid sequence motif selected from: an amino acid sequence motif 1 having at least 90% identity to an amino acid sequence of AWK[AT][KS]C[KR]NVA[AV][LV]G[RQ]E[ML][CTS]TTAA[YH]I[SA][EQ]LQY[DEQ]I[QK]VQ[AE]MLQ[EDQ]IA[RQ][KR]QA[DE]RL[SE][SGA]I (SEQ ID NO: 123); an amino acid sequence motif 2 having at least 90% identity to an amino acid sequence of [EQ][SA]YDQ[ESD][LF][KR]Q[LF][KQ]LF[IV][AQ]QN[KE]ILG[SG]YLL[EQ]QN[RK]AFA[EA][KR]E[RK]DM[ED][VA]FHS (SEQ ID NO: 124); an amino acid sequence motif 3 having at least 90% identity to an amino acid sequence of F[HR]DRN[EK][TASGERDN]E[VP]L[HE]YEA[AG][TV][PG]L[DV]Y[HQ]YAY[NR]LDTG[EA]TT[LV][TS]NLPS (SEQ ID NO: 125); an amino acid sequence motif 4 having at least 90% identity to an amino acid sequence of ADL[ST][SN][YF]TE[ML][VA][TS][QE]MD-MRTTR[LM]L[LV][EA]LIKVL[HNY][IM]QN[AGV]ALM Y[QE]YLS[EP][PA] (SEQ ID NO: 126); an amino acid sequence motif 5 having at least 90% identity to an amino acid sequence of PFT[RNT]WRLR[LV]SASA[EQ]EN[EKQ]GLAFP (SEQ ID NO: 127); an amino acid sequence motif 6 having at least 90% identity to an amino acid sequence of DW[LD]IF[VE]NE[VI]E[AG]VA[EA]QMP[TE]EVSE (SEQ ID NO: 128); an amino acid sequence motif 7 having at least 90% identity to an amino acid sequence of V[TN]M[EDQ]TVW[GR][ML]L[VI]Q[HQ]E[HQ]AA[IV][LQ]GL[LM][RQ]LG[PA][SAP][FS]D[FI][T RV]RT[YF]VVKDIPV[DS]LLL[DH]G (SEQ ID NO: 129); an amino acid sequence motif 8 having at least 90% identity to an amino acid sequence of IRLD[QK]MEFSEVM[VA][IV]HRM[FH][IVF][RK][LM][DP][DE]LD[IVL][AG][HL] (SEQ ID NO: 130); an amino acid sequence motif 9 having at least 90% identity to an amino acid sequence of [AL]A[RE][GK]L[QKE][RK]V[LV][EQ]IL[ED][GD]LQA[VA]MEVV[AK][AI]I[KN][DE]LVES-LQE[LI V]GQLV[DE]AP[ED]MP[DE][ML]P[TS]E (SEQ ID NO: 131); an amino acid sequence motif 10 having at least 90% identity to an amino acid sequence of [TV]FP[LS][TS][WL]SRVRI[HR][HY][LV]EMKF[VD][GQA][AG]A (SEQ ID NO: 132); an amino acid sequence motif 11 having at least 90% identity to an amino acid sequence of [RK]Q[VL]A[RN]A[LV]FAV[LF][GR]AI[AG][AS][VI][AG]L[AT][FVL][ALV]TGGA (SEQ ID NO: 133); an amino acid sequence motif 12 having at least 90% identity to an amino acid sequence of [QL][RK][QRT][STI]EL[DQ]N[TA][IML][QE][KR][MI]DQLSLQMET[QE]S[AE][DA]M[ED]QA[KQ R][AE]DM[ED][AE] (SEQ ID NO: 134); an amino acid sequence motif 13 having at least 90% identity to an amino acid sequence of LVVP[QR]LQY[DH]MYSN-LI[ND][RQ][ML][AV][QR]VA (SEQ ID NO: 135); an amino acid sequence motif 14 having at least 90% identity to an amino acid sequence of [PA][DV]A[LV]LTDP[NS][IV][LI][LS][GC]MQT[ST][ML]LIAELV[EL][FV][AS][HQ][PN]SS (SEQ ID NO: 136); an amino acid sequence motif 15 having at least 90% identity to an amino acid sequence of [AT][TV][SG]A[DG][AD]TTQIAITF[HYF][VI][ST]AIR[RQE]I (SEQ ID NO: 137); an amino acid sequence motif 16 having at least 90% identity to an amino acid sequence of LEGA[ED]KVKRLYVFADVVEL[PE][SG]K (SEQ ID NO: 138); an amino acid sequence motif 17 having at least 90% identity to an amino acid sequence of P[IV]TD[TS]GE[VI]Y[IM]LLQ[SG]SR (SEQ ID NO: 139); an amino acid sequence motif 18 having at least 90% identity to an amino acid sequence of T[VL][RS]LPG[ST][IV][MS]VVILCR[VI]L[HV][LV]N[GS] (SEQ ID NO: 140); an amino acid sequence motif 19 having at least 90% identity to an amino acid sequence of [AV]V[TR][KR]H[VA]EWLN[KT]LL[LV]Q[AV]SAAAQ[GS] (SEQ ID NO: 141); an amino acid sequence motif 20 having at least 90% identity to an amino acid sequence of [YV][LV]ALL[FY]R[AT]Q[YA][LVF][IL]K[LGM]V[GK] (SEQ ID NO: 142); an amino acid sequence motif 21 having at least 90% identity to an amino acid sequence of AP[GAL]A[VIM][AS]AA[KGR][GA]AV[ST][AI]AG (SEQ ID NO: 143) an amino acid sequence motif 22 having at least 90% identity to an amino acid sequence of [ED]D[WY][EQ]FE[IL]PVEDF (SEQ ID NO: 144); an amino acid sequence motif 23 having at least 90% identity to an amino acid sequence of YS[EH]LYR[DE][LV]NQ[VI]S (SEQ ID NO: 145); an amino acid sequence motif 24 having at least 90% identity to an amino acid sequence of F[AI][NR]TFMRMT (SEQ ID NO: 146).

In some embodiments the PtIP-50 polypeptide comprises at least one amino acid sequence motif selected from: an amino acid sequence motif 1 as represented by an amino acid sequence of the formula AWK[ATS][KSRT]C[KR]NVA[AVLI][LVI]G[RQKN]E[MLIV][CTS]TTAA[YHWF]I[SAT][EQDN]L QY[DEQN]I[QKNR]VQ[AED]MLQ[EDQN]IA[RQKN][KR]QA[DE]RL[SETD][SGAT]I (SEQ ID NO: 99); an amino acid sequence motif 2 as represented by an amino acid sequence of the formula [EQND][SAT]YDQ[ESDT][LFIV][KR]Q[LFIV][KQRN]LF[IVL][AQN]QN[KERD]ILG[SGT]YLL[E QDN]QN[RK]AFA[EAD][KR]E[RK]DM[ED][VAIL]FHS (SEQ ID NO: 100); an amino acid sequence motif 3 as represented by an amino acid sequence of the formula F[HRK]DRN[EKDR][TASG-ERDNKQ]E[VPIL]L[HERKD]YEA[AG][TVSIL][PG]L[DVELI]Y[HQN]YAY[NRQK]LDTG[EAD]TT[LVI][TS]NLPS (SEQ ID NO: 101); an amino acid sequence motif 4 as represented by an amino acid sequence of the formula ADL[ST][SNTQ][YFW]TE[MLIV][VAIL][TS][QEDN]MDMRTTR[LMIV]L[LVI][EAD]LIKVL[HNYW F][IMV-L]QN[AGVIL]ALMY[QEDN]YLS[EPD][PA] SEQ ID NO: 102); an amino acid sequence motif 5 as represented by an amino acid sequence of the formula PFT[RNTKQS]WRLR[LVI]SASA[EQDN]EN[EKQDRN]GLAFP (SEQ ID NO: 103); an amino acid sequence motif 6 as represented by an amino acid sequence of the formula DW[LDIVE]IF[VEILD]NE[VIL]E[AG]VA[EAD]QMP[TESD]EVSE (SEQ ID NO: 104); an amino acid sequence motif 7 as represented by an amino acid sequence of the formula V[TNSQ]M[EDQN]TVW[GRK][MLIV]L[VIL]Q[HQN]E[HQN]AA[IVL][LQIVN]GL[LMIV][RQKN]L G[PA][SAPT][FSWYT]D[FILV][TRVSKIL]RT[YFW]VVK-DIPV[DSET]LLL[DHE]G (SEQ ID NO: 105); an amino acid sequence motif 8 as represented by an amino acid sequence of the formula IRLD[QKNR]MEFSEVM[VAIL][IVL]HRM[FHYW][IVFL][RK][LMIV][DPE][DE]LD[IVL][AG][HLIV] (SEQ ID NO: 106); an amino acid sequence motif 9 as represented by an amino acid sequence of the formula [ALIV]A[REKD][GKR]L[QKENRD][RK]V[LVI][EQDN]IL[ED][GDE]LQA[VAIL]MEVV[AKR][AILV]I[KNRQ][DE]LVESLQE[LIV]GQLV[DE]AP[ED]MP[DE][MLIV]P[TS]E (SEQ ID NO: 107); an amino acid sequence motif 10 as represented by an amino acid sequence of the formula [TVSIL][FP][LSIVT][TS][WLYFVI]SRVRI[HRK][HYWF][LVI]EMKF[VDILE][GQAN][AG]A (SEQ ID NO: 108); an amino acid sequence motif 11 as represented by an amino acid sequence of the formula [RK]Q[VLI]A[RN]A[LVI]FAV[LFIV][GRK]AI[AG][AST][VIL][AG]L[ATS][FVLI][ALVI]TGGA (SEQ ID NO: 109); an amino acid sequence motif 12 as represented by an amino acid sequence of the formula [QLNIV][RK][QRTNKS][STILV]EL[DQEN]N[TAS][IMLV][QEDN][KR][MIVL]DQLSLQMET[QED N]S[AED][DAE]M[ED]QA[KQRN]

[AED]DM[ED][AED] (SEQ ID NO: 110); an amino acid sequence motif 13 as represented by an amino acid sequence of the formula LWP[QRNK]LQY[DHE]MYSNLI[NDQE][RQKN][MLIV][AVIL][QRNK]VA (SEQ ID NO: 111); an amino acid sequence motif 14 as represented by an amino acid sequence of the formula [PA][DVELI]A[LVI]LTDP[NSQT][IVL][LIV][LSIVT][GC]MQT[ST][MLIV]LI-AELV[ELDIV][FVIL][A ST][HQN][PNQ]SS (SEQ ID NO: 112); an amino acid sequence motif 15 as represented by an amino acid sequence of the formula [ATS][TVSIL][SGT]A[DGE][ADE]TTQIAITF[HYFW][VIL][ST]AIR[RQEKND]I (SEQ ID NO: 113); an amino acid sequence motif 16 as represented by an amino acid sequence of the formula LEGA[ED]KVKRLYVFADVVEL[PED][SGT]K (SEQ ID NO: 114); an amino acid sequence motif 17 as represented by an amino acid sequence of the formula P[IVL]TD[TS]GE[VIL]Y[IMVL]LLQ[SGT]SR (SEQ ID NO: 115); an amino acid sequence motif 18 as represented by an amino acid sequence of the formula T[VLI][RSKT]LPG[ST][IVL][MST]WILCR[VIL]L[HVIL][LVI]N[GST] (SEQ ID NO: 116); an amino acid sequence motif 19 as represented by an amino acid sequence of the formula [AVIL]V[TR][KR]H[VAIL]EWLN[KT]LL[LVI]Q[AVIL]SAAAQ[GST] (SEQ ID NO: 117); an amino acid sequence motif 20 as represented by an amino acid sequence of the formula [YV][LVI]ALL[FYW]R[ATS]Q[YAWF][LVFI][ILV]K[LGMIV]V[GKR] (SEQ ID NO: 118); and an amino acid sequence motif 21 as represented by an amino acid sequence of the formula AP[GALIV]A[VIML][AST]AA[KGR][GA]AV[ST][AIL]AG (SEQ ID NO: 119); an amino acid sequence motif 22 as represented by an amino acid sequence of the formula [ED]D[WYF][EQDN]FE[ILV]PVEDF (SEQ ID NO: 120); an amino acid sequence motif 23 as represented by an amino acid sequence of the formula YS[EHD]LYR[DE][LVI]NQ[VIL]S (SEQ ID NO: 121) an amino acid sequence motif 24 as represented by an amino acid sequence of the formula F[AIV][NRQK]TFMRMT (SEQ ID NO: 122).

In some embodiments the PtIP-50 polypeptide comprises at least one amino acid sequence motif selected from: an amino acid sequence motif 1 having at least 90% identity to an amino acid sequence of AWK[ATS][KS]C[KR]NVA[AVIL][LVI]G[RQKN]E[MLIV][CTS]TTAA[YHWF]I[SAT][EQDN]LQY[DEQN]I[QKNR]VQ[AED]MLQ[EDQN]IA[RQKN][KR]QA[DE]RL[SETD][SGAT]I (SEQ ID NO: 99); an amino acid sequence motif 2 having at least 90% identity to an amino acid sequence of [EQDN][SAT]YDQ[ESDT][LFIV][KR]Q[LFIV][KQRN]LF[IVL][AQN]QN[KERD]ILG[SGT]YLL[E QDN]QN[RK]AFA[EAD][KR]E[RK]DM[ED][VAIL]FHS (SEQ ID NO: 100); an amino acid sequence motif 3 having at least 90% identity to an amino acid sequence of F[HRK]DRN[EKDR][TASG-ERDNKQ]E[VPIL]L[HERKD]YEA[AG][TVSIL][PG]L[DVELI]Y[HQN]YAY[NRQK]LDTG[EAD]TT[LVI][TS]NLPS (SEQ ID NO: 101); an amino acid sequence motif 4 having at least 90% identity to an amino acid sequence of ADL[ST][SNTQ][YFW]TE[MLIV][VAIL][TS][QEDN]MDMRTTR[LMIV]L[LVI][EAD]LIKVL[HNYW F][IMV-L]QN[AGVIL]ALMY[QEDN]YLS[EPD][PA] (SEQ ID NO: 102); an amino acid sequence motif 5 having at least 90% identity to an amino acid sequence of PFT[RNTKQS]WRLR[LVI]SASA[EQDN]EN[EKQDRN]GLAFP (SEQ ID NO: 103); an amino acid sequence motif 6 having at least 90% identity to an amino acid sequence of DW[LDIVE]IF[VEILD]NE[VIL]E[AG]VA[EAD]QMP[TESD]EVSE (SEQ ID NO: 104); an amino acid sequence motif 7 having at least 90% identity to an amino acid sequence of V[TNSQ]M[EDQN]TVW[GRK][MLIV]L[VIL]Q[HQN]E[HQN]AA[IVL][LQIVN]GL[LMIV][RQKN]L G[PA][SAPT][FSWYT]D[FILV][TRVSKIL]RT[YFW]VVKDIPV[DSET]LLL[DHE]G (SEQ ID NO: 105); an amino acid sequence motif 8 having at least 90% identity to an amino acid sequence of IRLD[QKNR]MEFSEVM[VAIL][IVL]HRM[FHYW][IVFL][RK][LMIV][DPE][DE]LD[IVL][AG][HLIV] (SEQ ID NO: 106); an amino acid sequence motif 9 having at least 90% identity to an amino acid sequence of [ALIV]A[REKD][GKR]L[QKENRD][RK]V[LVI][EQDN]IL[ED][GDE]LQA[VAIL]MEVV[AKR][AILV ][KNRQ][DE]LVESLQE[LIV]GQLV[DE]AP[ED]MP[DE][MLIV]P[TS]E (SEQ ID NO: 107); an amino acid sequence motif 10 having at least 90% identity to an amino acid sequence of [TVSIL][FP[LSIVT][TS][WLYFVI]SRVRI[HRK][HYWF][LVI]EMKF[VDILE][GQAN][AG]A (SEQ ID NO: 108); an amino acid sequence motif 11 having at least 90% identity to an amino acid sequence of [RK]Q[VLI]A[RN]A[LVI]FAV[LFIV][GRK]AI[AG][AST][VIL][AG]L[ATS][FVLI][ALVI]TGGA (SEQ ID NO: 109); an amino acid sequence motif 12 having at least 90% identity to an amino acid sequence of [QLNIV][RK][QRTNKS][STILV]EL[DQEN]N[TAS][IMLV][QEDN][KR][MIVL]DQLSLQMET[QED N]S[AED][DAE]M[ED]QA[KQRN][AED]DM[ED][AED] (SEQ ID NO: 110); an amino acid sequence motif 13 having at least 90% identity to an amino acid sequence of LWP[QRNK]LQY[DHE]MYSNLI[NDQE][RQKN][MLIV][AVIL][QRNK]VA (SEQ ID NO: 111); an amino acid sequence motif 14 having at least 90% identity to an amino acid sequence of [PA][DVELI]A[LVI]LTDP[NSQT][IVL][LIV][LSIVT][GC]MQT[ST][MLIV]LIAELV[ELDIV][FVIL][A ST][HQN][PNQ]SS (SEQ ID NO: 112); an amino acid sequence motif 15 having at least 90% identity to an amino acid sequence of [ATS][TVSIL][SGT]A[DGE][ADE]TTQIAITF[HYFW][VIL][ST]AIR[RQEKND]I (SEQ ID NO: 113); an amino acid sequence motif 16 having at least 90% identity to an amino acid sequence of LEGA[ED]KVKRLYVFADVVEL[PED][SGT]K (SEQ ID NO: 114); an amino acid sequence motif 17 having at least 90% identity to an amino acid sequence of P[IVL]TD[TS]GE[VIL]Y[IMVL]LLQ[SGT]SR (SEQ ID NO: 115); an amino acid sequence motif 18 having at least 90% identity to an amino acid sequence of T[VLI][RSKT]LPG[ST][IVL][MST]WILCR[VIL]L[HVIL][LVI]N[GST] (SEQ ID NO: 116); an amino acid sequence motif 19 having at least 90% identity to an amino acid sequence of [AVIL]V[TR][KR]H[VAIL]EWLN[KT]LL[LVI]Q[AVIL]SAAAQ[GST] (SEQ ID NO: 117); an amino acid sequence motif 20 having at least 90% identity to an amino acid sequence of [YV][LVI]ALL[FYW]R[ATS]Q[YAWF][LVFI][ILV]K[LGMIV]V[GKR] (SEQ ID NO: 118); and an amino acid sequence motif 21 having at least 90% identity to an amino acid sequence of AP[GALIV]A[VIML][AST]AA[KGR][GA]AV[ST][AIL]AG (SEQ ID NO: 119); an amino acid sequence motif 22 having at least 90% identity to an amino acid sequence of [ED]D[WYF][EQDN]FE[ILV]PVEDF (SEQ ID NO: 120); an amino acid sequence motif 23 having at least 90% identity to an amino acid sequence of YS[EHD]LYR[DE][LVI]NQ[VIL]S (SEQ ID NO: 121), and an amino acid sequence motif 24 having at least 90% identity to an amino acid sequence of F[AIV][NRQK]TFMRMT (SEQ ID NO: 122).

In some embodiments the PtIP-50 polypeptide comprises sequentially from the N-terminus to the C-terminus at least one amino acid sequence motif selected from: motif 23, motif 8, motif 16, motif 18, motif 14, motif 19, motif 20, motif 13, motif 2, motif 12, motif 11, motif 21, motif 9, motif 6, motif 1, motif 4, motif 7, motif 22, motif 10, motif 17, motif 3, motif 24, motif 5, and motif 15.

In some embodiments a PtIP-50 polypeptide comprises sequentially from the N-terminus to the C-terminus: a Region A of between about 200 to about 300 amino acids in length having predominantly a nonconserved secondary structure; a Region B of between about 380 to about 465 amino acids in length having a consensus secondary structure comprising 8 to 10 segments of predominately alpha helical structure; and a Region C of between about 150 to about 180 amino acids in length having a consensus secondary structure comprising 6 to 8 segments of predominately beta strand structure. As used herein "predominantly a nonconserved secondary structure" means that the regions of secondary structure don't consistently align within the family of PtIP-50 polypeptides. As used herein "predominately alpha helical structure" means that secondary structure prediction may have one or more gap of between 1 to 4 amino acids of coil and/or beta strand structure intervening in the alpha helix structure. As used herein "predominately beta strand structure" means that secondary structure prediction may have a gap of between 1 to 4 amino acids of coil and/or alpha helix structure intervening in the beta strand structure. In some embodiments the secondary structure is generated by the PSIPRED, top ranked secondary structure prediction method (Jones D T. (1999) *J. Mol. Biol.* 292: 195-202).

In some embodiments a PtIP-50 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments a PtIP-50 polypeptide comprises sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length within about amino acid residue 50 to about amino acid residue 130 from the N-terminus of the PtIP-50 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure. As used herein, the term "about" when used in the context of the lower/upper limit of the length of a secondary structural element means the greater of –/+an integer of up to –/+20% of the length of the secondary structural element or –/+1 amino acid. By means of example, a secondary structure element of between about 3 amino acids and about 23 amino acids in length means a secondary structure element of between 2 and 27 amino acids in length.

In some embodiments a PtIP-50 polypeptide comprises sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length, a coil of between about 3 and about 18 amino acids in length and a beta strand 2 (β1b) of between about 4 and about 32 amino acids in length, within about amino acid residue 50 to about amino acid residue 165 from the N-terminus of the PtIP-50 polypeptide; a Region B of between about 380 to about 465 amino acids in length having a consensus secondary structure comprising nine segments of predominately alpha helical structure; and a Region C of between about 150 to about 180 amino acids in length having a consensus secondary structure comprising seven segments of predominately beta strand structure.

In some embodiments a PtIP-50 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure sequentially comprising i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 10 and about 17 amino acids in length; vi) a coil-3 of between about 11 and about 17 amino acids in length flanked by alpha helix-3 and alpha helix-4; vii) an alpha helix-4 of between about 24 and about 30 amino acids in length; viii) a coil-4 of between about 4 and about 13 amino acids in length flanked by alpha helix-4 and alpha helix-5; ix) an alpha helix-5 of between about 48 and about 58 amino acids in length; x) a coil-5 of between about 10 and about 15 amino acids in length flanked by alpha helix-5 and alpha helix-6; xi) an alpha helix-6 of between about 13 and about 15 amino acids in length; xii) a coil-6 of between about 3 and about 10 amino acids in length flanked by alpha helix-6 and alpha helix-7; xiii) an alpha helix-7 of between about 49 and about 59 amino acids in length; xiv) a coil-7 of between about 0 and about 9 amino acids in length flanked by alpha helix-7 and alpha helix-8; xv) an alpha helix-8 of between about 29 and about 36 amino acids in length; xvi) a coil-8 of between about 11 and about 16 amino acids in length flanked by alpha helix-8 and alpha helix-9; xvii) an alpha helix-9 of between about 16 and about 22 amino acids in length; xviii) a coil-9 of between about 5 and about 9 amino acids in length flanked by alpha helix-9 and Region C; and a Region C of between about 150 to about 180 amino acids in length having a consensus secondary structure comprising seven segments of predominately beta strand structure.

In some embodiments a PtIP-50 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure comprising nine segments of predominately alpha helical structure; and a Region C of between about 150 to about 180 amino acids in length having a consensus secondary structure sequentially comprising i) a beta strand-1 (β1) of between about 5 amino acids and about 7 amino acids in length; ii) a coil of between about 12 amino acids and about 17 amino acids in length; iii) a beta strand-2 (β2) of between about 11 amino acids and about 15 amino acids in length; iv) a coil of between about 7 amino acids and about 23 amino acids in length; v) a beta strand-3 (β3) of between about 5 amino acids and about 8 amino acids in length; vi) a coil of between about 13 amino acids and about 23 amino acids in length; vii) a beta strand-4 (β4) of between about 3 amino acids and about 7 amino acids in length; viii) a coil of between about 3 amino acids and about 8 amino acids in length; ix) a beta strand-5 (β5) of between about 4 amino acids and about 10 amino acids in length; x) a coil of between about 24 amino acids and about 28 amino acids in length; xi) a beta strand-6 (β6) of between about 5 amino acids and about 7 amino acids in length; xii) a coil of between about 17 amino acids and about 23 amino acids in length; and xiii) a beta strand-1 (β7) of between about 5 amino acids and about 7 amino acids in length.

In some embodiments a PtIP-50 polypeptide comprises sequentially from the N-terminus to the C-terminus: a Region A of between about 200 to about 300 amino acids in length having a predominantly nonconserved secondary structure; a Region B of between about 380 to about 465 amino acids in length having a consensus secondary structure sequentially comprising i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 10 and about 17 amino acids in length; vi) a coil-3 of between about 11 and about 17 amino acids in length flanked by alpha helix-3 and alpha helix-4; vii) an alpha helix-4 of between about 24 and about 30 amino acids in length; viii) a coil-4 of between about 4 and about 13 amino acids in length flanked by alpha helix-4 and alpha helix-5; ix) an alpha helix-5 of between about 48 and about 58 amino acids in length; x) a coil-5 of between about 10 and about 15 amino acids in length flanked by alpha helix-5 and alpha helix-6; xi) an alpha helix-6 of between about 13 and about 15 amino acids in length; xii) a coil-6 of between about 3 and about 10 amino acids in length flanked by alpha helix-6 and alpha helix-7; xiii) an alpha helix-7 of between about 49 and about 59 amino acids in length; xiv) a coil-7 of between about 0 and about 9 amino acids in length flanked by alpha helix-7 and alpha helix-8; xv) an alpha helix-8 of between about 29 and about 36 amino acids in length; xvi) a coil-8 of between about 11 and about 16 amino acids in length flanked by alpha helix-8 and alpha helix-9; xvii) an alpha helix-9 of between about 16 and about 22 amino acids in length; xviii) a coil-9 of between about 5 and about 9 amino acids in length flanked by alpha helix-9 and beta strand-1 (β1) of Region C; and a Region C of between about 150 to about 180 amino acids in length having a consensus secondary structure sequentially comprising i) a beta strand-1 (β1) of between about 5 amino acids and about 7 amino acids in length; ii) a coil of between about 12 amino acids and about 17 amino acids in length; iii) a beta strand-2 (β2) of between about 11 amino acids and about 15 amino acids in length; iv) a coil of between about 7 amino acids and about 23 amino acids in length; v) a beta strand-3 (β3) of between about 5 amino acids and about 8 amino acids in length; vi) a coil of between about 13 amino acids and about 23 amino acids in length; vii) a beta strand-4 (β4) of between about 3 amino acids and about 7 amino acids in length; viii) a coil of between about 3 amino acids and about 8 amino acids in length; ix) a beta strand-5 (β5) of between about 4 amino acids and about 10 amino acids in length; x) a coil of between about 24 amino acids and about 28 amino acids in length; xi) a beta strand-6 (β6) of between about 5 amino acids and about 7 amino acids in length; xii) a coil of between about 17 amino acids and about 23 amino acids in length; and xiii) a beta strand-1 (β7) of between about 5 amino acids and about 7 amino acids in length.

In some embodiments a PtIP-50 polypeptide comprises sequentially from the N-terminus to the C-terminus: a Region A of between about 200 to about 300 amino acids in length having a flexible consensus secondary structure, wherein the Region A comprises a conserved beta strand 1 (β1a) of between about 4 and about 12 amino acids in length within about amino acid residue 50 to about amino acid residue 130 from the N-terminus of the PtIP-50 polypeptide; a Region B of between about 380 to about 465 amino acids in length having a consensus secondary structure sequentially comprising i) an alpha helix-1 of between about 10 and about 26 amino acids in length; ii) a coil-1 of between about 2 and about 8 amino acids in length flanked by alpha helix-1 and alpha helix-2; iii) an alpha helix-2 of between about 15 and about 24 amino acids in length; iv) a coil-2 of between about 4 and about 14 amino acids in length flanked by alpha helix-2 and alpha helix-3; v) an alpha helix 3 of between about 10 and about 17 amino acids in length; vi) a coil-3 of between about 11 and about 17 amino acids in length flanked by alpha helix-3 and alpha helix-4; vii) an alpha helix-4 of between about 24 and about 30 amino acids in length; viii) a coil-4 of between about 4 and about 13 amino acids in length flanked by alpha helix-4 and alpha helix-5; ix) an alpha helix-5 of between about 48 and about 58 amino acids in length; x) a coil-5 of between about 10 and about 15 amino acids in length flanked by alpha helix-5 and alpha helix-6; xi) an alpha helix-6 of between about 13 and about 15 amino acids in length; xii) a coil-6 of between about 3 and about 10 amino acids in length flanked by alpha helix-6 and alpha helix-7; xiii) an alpha helix-7 of between about 49 and about 59 amino acids in length; xiv) a coil-7 of between about 0 and about 9 amino acids in length flanked by alpha helix-7 and alpha helix-8; xv) an alpha helix-8 of between about 29 and about 36 amino acids in length; xvi) a coil-8 of between about 11 and about 16 amino acids in length flanked by alpha helix-8 and alpha helix-9; xvii) an alpha helix-9 of between about 16 and about 22 amino acids in length; xviii) a coil-9 of between about 5 and about 9 amino acids in length flanked by alpha helix-9 and beta strand-1 (β1) of Region C; and a Region C of between about 150 to about 180 amino acids in length having a consensus secondary structure sequentially comprising i) a beta strand-1 (β1) of between about 5 amino acids and about 7 amino acids in length; ii) a coil of between about 12 amino acids and about 17 amino acids in length; iii) a beta strand-2 (β2) of between about 11 amino acids and about 15 amino acids in length; iv) a coil of between about 7 amino acids and about 23 amino acids in length; v) a beta strand-3 (β3) of between about 5 amino acids and about 8 amino acids in length; vi) a coil of between about 13 amino acids and about 23 amino acids in length; vii) a beta strand-4 (β4) of between about 3 amino acids and about 7 amino acids in length; viii) a coil of between about 3 amino acids and about 8 amino acids in length; ix) a beta strand-5 (β5) of between about 4 amino acids and about 10 amino acids in length; x) a coil of between about 24 amino acids and about 28 amino acids in length; xi) a beta strand-6 (β6) of between about 5 amino acids and about 7 amino acids in length; xii) a coil of between about 17 amino acids and about 23 amino acids in length; and xiii) a beta strand-1 (β7) of between about 5 amino acids and about 7 amino acids in length.

In some embodiments a PtIP-50 polypeptide has a calculated molecular weight of between about 70kD and about 120kD, between about 75kD and about 110kD, between about 80kD and about 105kD, or between about 85kD and about 105kD.

In some embodiments the PtIP-50 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the PtIP-50 polypeptide has increased digestibility of proteolytic fragments in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al *J. Agric Food Chem.* 50: 7154-7160, 2002).

PtIP-65 Polypeptides

In some embodiments the PtIP-65 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42, wherein the PtIP-65 polypeptide, in combination with a PtIP-50 polypeptide, has insecticidal activity.

In some embodiments the PtIP-65 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 22, SEQ ID NO: 24, SEQ ID NO: 26 or SEQ ID NO: 29, wherein the PtIP-65 polypeptide, in combination with a PtIP-50 polypeptide, has insecticidal activity.

In some embodiments the PtIP-65 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 25, SEQ ID NO: 27, SEQ ID NO: 30, SEQ ID NO: 31, SEQ ID NO: 34, SEQ ID NO: 35 or SEQ ID NO: 36, wherein the PtIP-65 polypeptide in combination with a PtIP-50 polypeptide has insecticidal activity.

In some embodiments the PtIP-65 polypeptide comprises an amino acid sequence having at least 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 23, SEQ ID NO: 28, SEQ ID NO: 31, SEQ ID NO: 32 or SEQ ID NO: 33, wherein the PtIP-65 polypeptide, in combination with a PtIP-50 polypeptide, has insecticidal activity. In some embodiments the PtIP-65 polypeptide comprises an amino acid sequence having at least 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 41 or SEQ ID NO: 42, wherein the PtIP-65 polypeptide, in combination with a PtIP-50 polypeptide, has insecticidal activity.

In some embodiments the PtIP-65 polypeptide comprises an amino acid sequence having at least 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 38 or SEQ ID NO: 40, wherein the PtIP-65 polypeptide, in combination with a PtIP-50 polypeptide, has insecticidal activity.

In some embodiments the PtIP-65 polypeptide comprises an amino acid sequence having at least 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 37, wherein the PtIP-65 polypeptide, in combination with a PtIP-50 polypeptide, has insecticidal activity.

In some embodiments the PtIP-65 polypeptide comprises an amino acid sequence having at least 40%, 45%, 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identity to the amino acid sequence of SEQ ID NO: 39, wherein the PtIP-65 polypeptide, in combination with a PtIP-50 polypeptide, has insecticidal activity.

In some embodiments the PtIP-65 polypeptide is derived from a fern species in the Division *Pteridophyta*. The phylogeny of ferns as used herein is based on the classification for extant ferns by A. R. Smith et al, *TAXON*, 55:705-731 (2006). The consensus phylogeny based on the classification by A. R. Smith is shown in FIG. 1. Additional information on the phylogeny of ferns can be found at mobot.org/MOBOT/research/APweb/(which can be accessed using the "www" prefix) and Schuettpelz E. and Pryer K. M., *TAXON* 56: 1037-1050 (2007) based on three plastid genes. Additional fern and other primitive plant species can be found at homepages.caverock.net.nz/~by-fern/list.htm (which can be accessed using the http:// prefix).

In some embodiments the PtIP-65 polypeptide is derived from a fern species in the Class Psilotopsida. In some embodiments the PtIP-65 polypeptide is derived from a fern species in the Class Psilotopsida, Order Psilotales. In some embodiments the PtIP-65 polypeptide is derived from a fern species in the Class Psilotopsida, Order Ophioglossales. In some embodiments the PtIP-65 polypeptide is derived from a fern species in the Class Psilotopsida, Order Ophioglossales, Family Psilotaceae. In some embodiments the PtIP-65 polypeptide is derived from a fern species in the Class Psilotopsida, Order Ophioglossales Family Ophioglossaceae. In some embodiments the PtIP-65 polypeptide is derived from a fern species in the Genus *Ophioglossum* L., *Botrychium, Botrypus, Helminthostachys, Ophioderma, Cheiroglossa, Sceptridium* or *Mankyua*. In some embodiments the PtIP-65 polypeptide is derived from a fern species in the *Ophioglossum* L. Genus is selected from but not limited to *Ophioglossum californicum, Ophioglossum coriaceum, Ophioglossum costatum, Ophioglossum crotalophoroides, Ophioglossum engelmannii, Ophioglossum falcatum, Ophioglossum gomezianum, Ophioglossum gramineum, Ophioglossum kawarnurae, Ophioglossum lusitanicum, Ophioglossum namegatae, Ophioglossum nudicaule, Ophioglossum palmatum, Ophioglossum parvum, Ophioglossum pedunculosum, Ophioglossum pendulum, Ophioglossum petiolatum, Ophioglossum pusillum, Ophioglossum reticulatum, Ophioglossum richardsiae, Ophioglossum thermale,* and *Ophioglossum vulgatum.*

In some embodiments the PtIP-65 polypeptide is derived from a species in the Class Polypodiopsida/Pteridopsida. In some embodiments the PtIP-65 polypeptide is derived from a fern species in the Order Osmundales (royal ferns); Family Osmundaceae. In some embodiments the PtIP-65 polypeptide is derived from a fern species in the Order Hymenophyllales (filmy ferns and bristle ferns); Family Hymenophyllaceae. In some embodiments the PtIP-65 polypeptide is derived from a fern species in the Order Gleicheniales; Family Gleicheniaceae, Family Dipteridaceael or Family Matoniaceae. In some embodiments the PtIP-65 polypeptide is derived from a fern species in the Order Schizaeales; Family Lygodiaceae, Family Anemiaceae or Family Schizaeaceae. In some embodiments the PtIP-65 polypeptide is derived from a fern species in the Order Salviniales; Family Marsileaceae or Family Salviniaceae. In some embodiments the PtIP-65 polypeptide is derived from a fern species in the Order Cyatheales; Family Thyrsopteridaceae, Family Loxsomataceae, Family Culcitaceae, Family Plagiogyriaceae, Family Cibotiaceae, Family Cyatheaceae, Family Dicksoniaceae or Family Metaxyaceae.

In some embodiments the PtIP-65 polypeptide is derived from a fern species in the Order Polypodiales; Family Lindsaeaceae, Family Saccolomataceae, Family Cystodiaceae, Family Dennstaedtiaceae, Family Pteridaceae, Family Aspleniaceae, Family Thelypteridaceae, Family Woodsiaceae, Family Onocleaceae, Family Blechnaceae, Family Dryopteridaceae, Family Lomariopsidaceae, Family Tectariaceae, Family Oleandraceae, Family Davalliaceae or Family Polypodiaceae.

In some embodiments the PtIP-65 polypeptide is derived from a fern species in the Order Polypodiales, Family Pteridaceae, Genus *Adiantaceae* selected from but not limited to *Adiantum aethiopicum, Adiantum aleuticum, Adiantum bonatianum, Adiantum cajennense, Adiantum capillus-junonis, Adiantum capillus-veneris, Adiantum caudatum, Adiantum chienfi, Adiantum chilense, Adiantum cuneatum, Adiantum cunninghamfi, Adiantum davidii, Adiantum diaphanum, Adiantum edentulum, Adiantum edgeworthfi, Adiantum excisum, Adiantum fengianum, Adiantum fimbriatum, Adiantum flabellulaturn, Adiantum formosanum, Adiantum formosum, Adiantum fulvum, Adiantum gravesfi, Adiantum hispidulum, Adiantum induratum, Adiantum jordanfi, Adiantum juxtapositum, Adiantum latifolium, Adiantum leveillei, Adiantum lianxianense, Adiantum malesianum, Adiantum mariesfi, Adiantum monochlamys, Adiantum myriosorum, Adiantum obliquum, Adiantum ogasawarense, Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum venustum, Adiantum viridescens,* and *Adiantum viridimontanurn.*

In some embodiments the PtIP-65 polypeptide is derived from a fern species in the Order Polypodiales, Family Aspleniaceae, Genus *Asplenium* L. In some embodiments the PtIP-65 polypeptide is derived from a fern species in the Order Polypodiales, Family Aspleniaceae, Genus *Asplenium* L selected from but not limited to *Asplenium abbreviatum, Asplenium abrotanoides, Asplenium abscissum* var. *subaequilaterale, Asplenium abscissum, Asplenium achilleifolium, Asplenium acuminatum, Asplenium adiantifrons, Asplenium adiantoides, Asplenium adiantoides* var. *squamulosum, Asplenium adiantum-nigrum* L., *Asplenium adiantum-nigrum* var. *adiantum-nigrum, Asplenium adiantum-nigrum* var. *yuanurn, Asplenium adnatum, Asplenium aethiopicum, Asplenium affine, Asplenium affine* var. *affine, Asplenium affine* var. *gilpinae, Asplenium affine* var. *mettenii, Asplenium affine* var. *pecten, Asplenium africanum, Asplenium afzelii, Asplenium aitchisonii, Asplenium alatulum, Asplenium alatum, Asplenium alfredii, Asplenium altajense, Asplenium amabile, Asplenium ambohitantelense, Asplenium anceps* var. *proliferum, Asplenium andapense, Asplenium andersonii, Asplenium angustatum, Asplenium angustum, Asplenium anisophyllum, Asplenium annetii, Asplenium antiquum, Asplenium antrophyoides, Asplenium apertura, Asplenium apogamum, Asplenium aquaticum, Asplenium arboreum, Asplenium arcanum, Asplenium arcuatum, Asplenium argentinurn, Asplenium argutum, Asplenium aspidiiforme, Asplenium aspidioides, Asplenium asterolepis, Asplenium auricularium* var. *acutidens, Asplenium auricularium* var. *subintegerrimum, Asplenium auriculaturn, Asplenium auriculaturn* var. *aequilaterale, Asplenium auritum* fo. *diversifolium, Asplenium auritum* fo. *diversifolium, Asplenium auritum* fo. *nana, Asplenium auritum, Asplenium auritum* var. *auriculaturn, Asplenium auritum* var. *auritum, Asplenium auritum* var. *bipinnatifidum, Asplenium auritum* var. *bipinnatisectum, Asplenium auritum* var. *davallioides, Asplenium auritum* var. *macilentum, Asplenium auritum* var. *rigidum, Asplenium auritum* var. *subsimplex, Asplenium austrochinense, Asplenium ayopayense, Asplenium badinii, Asplenium balense, Asplenium ballivianii, Asplenium bangii, Asplenium bangii, Asplenium barbaense, Asplenium barclayanum, Asplenium barkamense, Asplenium barteri, Asplenium basiscopicum, Asplenium bicrenaturn, Asplenium bifrons, Asplenium bipartitum, Asplenium blastophorum, Asplenium blepharodes, Asplenium blepharophorum, Asplenium boiteaui, Asplenium bolivianum, Asplenium boltonii, Asplenium borealichinense, Asplenium bradei, Asplenium bradeorum, Asplenium bradleyi, Asplenium brausei, Asplenium breedlovei, Asplenium buettneri, Asplenium buettneri* var. *hildebrandtii, Asplenium bulbiferum, Asplenium bullaturn* var. *bullaturn, Asplenium bullatum* var. *shikokianum, Asplenium bullaturn, Asplenium cancellatum, Asplenium capillipes, Asplenium cardiophyllum* (Hance), *Asplenium caripense, Asplenium carvalhoanum, Asplenium castaneoviride, Asplenium castaneum, Asplenium cauda-* tum, Asplenium celtidifolium (Kunze), Asplenium ceratolepis, Asplenium changputungense, Asplenium chaseanum, Asplenium cheilosorum, Asplenium chengkouense, Asplenium chihuahuense, Asplenium chimantae, Asplenium chimborazense, Asplenium chingianum, Asplenium chlorophyllum, Asplenium chondrophyllum, Asplenium cicutarium, Asplenium cicutarium var. paleaceum, Asplenium cirrhaturn, Asplenium cladolepton, Asplenium claussenii, Asplenium coenobiale, Asplenium commutatum, Asplenium congestum, Asplenium conquisitum, Asplenium consimile, Asplenium contiguum, Asplenium contiguum var. hirtulum, Asplenium corderoi, Asplenium cordovense, Asplenium coriaceum, Asplenium corifolium, Asplenium correardii, Asplenium costale, Asplenium costale var. robustum, Asplenium cowanii, Asplenium crenulatoserrulatum, Asplenium crenulatum, Asplenium crinicaule, Asplenium crinulosum, Asplenium cristatum, Asplenium ctyptolepis Fernald, Asplenium cultrifolium L., Asplenium cuneatiforme, Asplenium cuneatum, Asplenium curvatura, Asplenium cuspidatum, Asplenium cuspidatum var cuspidatum, Asplenium cuspidatum var. foeniculaceum, Asplenium cuspidatum var. triculum, Asplenium cuspidatum var. tripinnaturn, Asplenium dalhousiae, Asplenium dareoides, Asplenium davallioides, Asplenium davisii, Asplenium debile, Asplenium debile, Asplenium decussatum, Asplenium delavayi, Asplenium delicatulum, Asplenium delicatulum var. cocosensis, Asplenium delitescens, Asplenium delitescens×laetum, Asplenium densum, Asplenium dentatum L., Asplenium dentatum L., Asplenium depauperatum, Asplenium deqenense, Asplenium dianae, Asplenium difforme, Asplenium dilatatum, Asplenium dimidiatum, Asplenium dimidiaturn var. boliviense, Asplenium diplazisorum, Asplenium dissectum, Asplenium distans, Asplenium divaricatum, Asplenium divergens, Asplenium divisissimurn, Asplenium doederleinii, Asplenium donnell-smithii, Asplenium dregeanum, Asplenium dulongjiangense, Asplenium duplicatoserratum, Asplenium eatonii, Asplenium ebeneum, Asplenium ebenoides, Asplenium ecuadorense, Asplenium eggersii, Asplenium emarginaturn, Asplenium enaturn, Asplenium ensiforme fo. bicuspe, Asplenium ensiforme fo. ensiforme, Asplenium ensiforme fo. stenophyllum, Asplenium ensiforme, Asplenium erectum var. erectum, Asplenium erectum var. gracile, Asplenium erectum var. usambarense, Asplenium erectum var. zeyheri, &, Asplenium erosum L., Asplenium escaleroense, Asplenium esculenturn, Asplenium eutecnurn, Asplenium excelsum, Asplenium excisum, Asplenium exiguum, Asplenium extensum, Asplenium falcatum, Asplenium falcinellum, Asplenium faurei, Asplenium feei, Asplenium fengyangshanense, Asplenium ferulaceum, Asplenium fibrillosum, Asplenium filix-femina, Asplenium finckii, Asplenium finlaysonianurn, Asplenium flabellulatum, Asplenium flabellulatum var flabellulatum, Asplenium flabellulatum var. partitum, Asplenium flaccidum, Asplenium flavescens, Asplenium flavidum, Asplenium flexuosum, Asplenium fluminense, Asplenium foeniculaceum, Asplenium formosanum, Asplenium formosum var. carolinurn, Asplenium formosum var. incultum, Asplenium formosum, Asplenium fournieri, Asplenium fragile, Asplenium fragile var. lomense, Asplenium fragrans, Asplenium fragrans var. foeniculaceum, Asplenium franconis var. gracile, Asplenium fraxinifolium, Asplenium friesiorum, Asplenium friesiorum var. nesophilum, Asplenium fugax, Asplenium fujianense, Asplenium furcatum, Asplenium furfuraceum, Asplenium fuscipes, Asplenium fuscopubescens, Asplenium galeottii, Asplenium gautieri, Asplenium gemmiferum, Asplenium gentryi, Asplenium geppii, Asplenium ghiesbreghtii, Asplenium gilliesii, Asplenium gilpinae, Asplenium glanduliserratum, Asplenium glenniei, Asplenium goldmannii, Asplenium gomezianum, Asplenium grande, Asplenium grandifolium, Asplenium grandifrons, Asplenium gregoriae, Asplenium griffithianum, Asplenium gulingense, Asplenium hainanense, Asplenium hallbergii, Asplenium hallei, Asplenium hallii, Asplenium hangzhouense, Asplenium haplophyllum, Asplenium harpeodes, Asplenium harpeodes var. glaucovirens, Asplenium harpeodes var. incisura, Asplenium harrisii Jenman, Asplenium harrisonii, Asplenium hastatum, Asplenium hebeiense, Asplenium hemionitideum, Asplenium hemitomurn, Asplenium henryi, Asplenium herpetopteris, Asplenium herpetopteris var herpetopteris, Asplenium herpetopteris var. acutipinnata, Asplenium herpetopteris var. masoulae, Asplenium herpetopteris var. villosum, Asplenium hesperium, Asplenium heterochroum, Asplenium hians, Asplenium hians var. pallescens, Asplenium hoffmannii, Asplenium holophlebium, Asplenium hondoense, Asplenium horridum, Asplenium hostmannii, Asplenium humistratum, Asplenium hypomelas, Asplenium inaequilaterale, Asplenium incisura, Asplenium incurvaturn, Asplenium indicum, Asplenium indicum var. indicum, Asplenium indicum var. yoshingagae, Asplenium induratum, Asplenium indusiatum, Asplenium inexpectatum, Asplenium insigne, Asplenium insiticium, Asplenium insoliturn, Asplenium integerrimurn, Asplenium interjectum, Asplenium jamesonii, Asplenium jaundeense, Asplenium juglandifolium, Asplenium kangdingense, Asplenium kansuense, Asplenium kassneri, Asplenium kaulfussii, Asplenium kellermanii, Asplenium kentuckiense, Asplenium khullarii, Asplenium kiangsuense, Asplenium kunzeanurn, Asplenium lacerum, Asplenium laciniatum, Asplenium laciniatum var. acutipinna, Asplenium laciniatum var. laciniatum, Asplenium laetum fo. minor, Asplenium laetum, Asplenium laetum var. incisoserratum, Asplenium lamprocaulon, Asplenium laserpitiifolium var. morrisonense, Asplenium lastii, Asplenium latedens, Asplenium latifolium, Asplenium laui, Asplenium laurentii, Asplenium leandrianurn, Asplenium lechleri, Asplenium leiboense, Asplenium lepidorachis, Asplenium leptochlamys, Asplenium leptophyllum, Asplenium levyi, Asplenium lindbergii, Asplenium lindeni, Asplenium lineatum, Asplenium lividum, Asplenium lobatum, Asplenium lobulaturn, Asplenium lokohoense, Asplenium longicauda, Asplenium longicaudaturn, Asplenium longifolium, Asplenium longisorum, Asplenium longjinense, Asplenium lorentzii, Asplenium loriceum, Asplenium loxogrammoides, Asplenium lugubre, Asplenium lunulatum, Asplenium lunulatum var. pteropus, Asplenium lushanense, Asplenium lydgatei, Asplenium macilentum, Asplenium macraei, Asplenium macrodictyon, Asplenium macrophlebium, Asplenium macrophyllum, Asplenium macropterum, Asplenium macrosorum, Asplenium macrotis, Asplenium macrurum, Asplenium mainlingense, Asplenium mangindranense, Asplenium mannii, Asplenium marginatum L., Asplenium marojejyense, Asplenium martianum, Asplenium matsumurae, Asplenium mauritiensis Lorence, Asplenium maximum, Asplenium, ii, Asplenium megalura, Asplenium megaphyllum, Asplenium meiotomurn, Asplenium melanopus, Asplenium membranifolium, Asplenium meniscioides, Asplenium mesosorum, Asplenium mexicanurn, Asplenium micropaleatum, Asplenium microtum, Asplenium mildbraedii, Asplenium mildei, Asplenium minimum, Asplenium minutum, Asplenium miradorense, Asplenium miyunense, Asplenium moccenianurn, Asplenium mocquetysii, Asplenium modestum, Asplenium monanthemum var. menziesii, Asplenium monanthes L., Asplenium monanthes var monanthes, Asplenium monanthes var. castaneum, Asplenium monanthes var. wagneri, Asplenium monanthes var. yungense, Asplenium monodon, Asplenium montanum, Asplenium mosetenense, Asplenium moupinense, Asplenium mucronatum, Asplenium munchii, Asplenium muticum, Asplenium myapteron, Asplenium myriophyllu, Asplenium nakanoanum, Asplenium nanchuanense, Asplenium nemorale, Asplenium neolaserpitiifolium, Asplenium neomutijugum, Asplenium neovarians, Asplenium nesii, Asplenium nesioticum, Asplenium nidus L., Asplenium nigricans, Asplenium niponicum, Asplenium normale, Asplenium normale var. angustum, Asplenium obesum, Asplenium oblongatum, Asplenium oblongifolium, Asplenium obovatum, Asplenium obscurum, Asplenium obscurum var. angustum, Asplenium obtusatum var. obtusatum, Asplenium obtusatum var. sphenoides, Asplenium obtusifolium L., Asplenium obtusissimum, Asplenium obversum, Asplenium ochraceum, Asplenium oellgaardii, Asplenium ofeliae, Asplenium oldhami, Asplenium oligosorum, Asplenium olivaceum, Asplenium onopteris L., Asplenium onustum, Asplenium ortegae, Asplenium otites, Asplenium palaciosii, Asplenium palmeri, Asplenium partitum, Asplenium parvisorum, Asplenium parviusculum, Asplenium parvulum, Asplenium patens, Asplenium paucifolium, Asplenium paucijugum, Asplenium paucivenosum, Asplenium pearcei, Asplenium pekinense, Asplenium pellucidum, Asplenium pendulum, Asplenium petiolulatum, Asplenium phyllitidis, Asplenium pimpinellifolium, Asplenium pinnatifidum, Asplenium pinnatum, Asplenium platyneuron, Asplenium platyneuron var. bacculumrubrum, Asplenium platyneuron var. incisum, Asplenium platyphyllum, Asplenium plumbeum, Asplenium poloense, Asplenium polymeris, Asplenium polymorphum, Asplenium polyodon, Asplenium polyodon var. knudsenii, Asplenium polyodon var. nitidulum, Asplenium polyodon var. sectum, Asplenium polyodon var. subcaudatum, Asplenium polyphyllum, Asplenium poolii, Asplenium poolii fo. simplex, Asplenium poolii var. linearipinnatum, Asplenium potosinum, Asplenium potosinum var. incisum, Asplenium praegracile, Asplenium praemorsum, Asplenium preussii, Asplenium pringleanum, Asplenium pringlei, Asplenium prionitis, Asplenium procerum, Asplenium progrediens, Asplenium projectum, Asplenium prolongatum, Asplenium propinquum, Asplenium protensum, Asplenium pseudoangustum, Asplenium pseudoerectum, Asplenium pseudofontanum, Asplenium pseudolaserpitiifolium, Asplenium pseudonormale, Asplenium pseudo pellucidum, Asplenium pseudopraemorsum, Asplenium pseudovarians, Asplenium pseudowilfordii, Asplenium pseudowrightii, Asplenium psilacrum, Asplenium pteropus, Asplenium pubirhizoma, Asplenium pulchellum, Asplenium pulchellum var. subhorizontale, Asplenium pulcherrimum, Asplenium pulicosum, Asplenium pulicosum var. maius, Asplenium pululahuae, Asplenium pumilum, Asplenium pumilum var. hymenophylloides, Asplenium pumilum var. laciniatum, Asplenium purdieanum, Asplenium purpurascens, Asplenium pyramidatum, Asplenium qiujiangense, Asplenium quercicola, Asplenium quitense, Asplenium raddianum, Asplenium radiatum, Asplenium radicans L., Asplenium radicans, Asplenium radicans var. costaricense, Asplenium radicans var. partitum, Asplenium radicans var. radicans, Asplenium radicans var. uniseriale, Asplenium recumbens, Asplenium reflexum, Asplenium regulare var. latior, Asplenium repandulum, Asplenium repens, Asplenium repente, Asplenium resiliens, Asplenium retusulum, Asplenium rhipidoneuron, Asplenium rhizophorum L., Asplenium rhizophyllum, Asplenium rhizophyllum L., Asplenium rhizophyllum var. proliferum, Asplenium rhomboideum, Asplenium rigidum, Asplenium riparium, Asplenium rivale, Asplenium rockii, Asplenium roemerianum, Asplenium roemerianum var. mindensis, Asplenium rosenstockianum, Asplenium rubinum, Asplenium ruizianum, Asplenium rusbyanum, Asplenium ruta-muraria L., Asplenium ruta-muraria var. cryptolepis, Asplenium rutaceum, Asplenium rutaceum var. disculiferum, Asplenium rutaefolium, Asplenium rutifolium, Asplenium salicifolium L., Asplenium salicifolium var. aequilaterale, Asplenium salicifolium var. salicifolium, Asplenium sampsoni, Asplenium sanchezii, Asplenium sanderi, Asplenium sandersonii, Asplenium sanguinolentum, Asplenium sarelii, Asplenium sarelii var. magnum, Asplenium sarelii var. sarelii, Asplenium saxicola, Asplenium scalifolium, Asplenium scandicinum, Asplenium schizophyllum, Asplenium schkuhrii, Asplenium sciadophilum, Asplenium scolopendrium L., Asplenium scortechinii, Asplenium seileri, Asplenium semipinnatum, Asplenium septentrionale, Asplenium serra, Asplenium serra var. imrayanum, Asplenium serratissimum, Asplenium serratum L., Asplenium serratum var. caudatum, Asplenium serricula, Asplenium sessilifolium, Asplenium sessilifolium var. guatemalense, Asplenium sessilifolium var. minus, Asplenium sessilifolium var. occidentale, Asplenium sessilipinnum, Asplenium setosum, Asplenium shepherdii, Asplenium shepherdii var. bipinnatum, Asplenium shepherdii var. flagelliferum, Asplenium shikokianum, Asplenium simii, Asplenium simonsianum, Asplenium sintenisii, Asplenium skinneri, Asplenium skinneri, Asplenium sodiroi, Asplenium soleirolioides, Asplenium solidum var. stenophyllum, Asplenium solmsii, Asplenium sp.-N.-Halle-2234, Asplenium spathulinum, Asplenium spectabile, Asplenium speluncae, Asplenium sphaerosporum, Asplenium sphenotomum, Asplenium spinescens, Asplenium splendens, Asplenium sprucei, Asplenium squamosum L., Asplenium standleyi, Asplenium stellatum, Asplenium stenocarpum, Asplenium stoloniferum, Asplenium stolonipes, Asplenium striatum L., Asplenium stuebelianum, Asplenium stuhlmannii, Asplenium suave, Asplenium subalatum, Asplenium subcrenatum, Asplenium subdigitatum, Asplenium subdimidiatum, Asplenium subintegrum, Asplenium sublaserpitiifolium, Asplenium sublongum, Asplenium subnudum, Asplenium suborbiculare, Asplenium subtenuifolium, Asplenium subtile, Asplenium subtoramanum, Asplenium subtrapezoideum, Asplenium subvarians, Asplenium sulcatum, Asplenium sylvaticum, Asplenium szechuanense, Asplenium taiwanense, Asplenium tenerrimum, Asplenium tenerum, Asplenium tenuicaule, Asplenium tenuifolium, Asplenium tenuifolium var. minor, Asplenium tenuifolium var. tenuifolium, Asplenium tenuissimum, Asplenium ternatum, Asplenium theciferum, Asplenium theciferum var. concinnum, Asplenium thunbergii, Asplenium tianmushanense, Asplenium tianshanense, Asplenium tibeticum, Asplenium tocoraniense, Asplenium toramanum, Asplenium trapezoideum, Asplenium tricholepis, Asplenium trichomanes L., Asplenium trichomanes subsp. inexpectans, Asplenium trichomanes subsp. quadrivalens, Asplenium trichomanes subsp. trichomanes, Asplenium trichomanes var. harovii, Asplenium trichomanes var. herbaceum, Asplenium trichomanes var. repens, Asplenium trichomanes var. viridissimum, Asplenium trichomanes-dentatum L., Asplenium trigonopterum, Asplenium trilobatum, Asplenium trilobum, Asplenium triphyllum, Asplenium triphyllum var. compactum, Asplenium triphyllum var. gracillimum, Asplenium triphyllum var. herbaceum, Asplenium tripteropus, Asplenium triquetrum, Asplenium truncorum, Asplenium tsaratananense, Asplenium tucumanense, Asplenium tuerckheimii, Asplenium tunquiniense, Asplenium ulbrichtii, Asplenium ultimum, Asplenium unilaterale, Asplenium unilaterale var. decurrens, Asplenium unilaterale var. udum, Asplenium unilaterale var. unilaterale, Asplenium uniseriale, Asplenium uropteron, Asplenium vagans, Asplenium vareschianum, Asplenium variabile var. pauci-

*jugum, Asplenium variabile* var. *variabile, Asplenium varians* subsp. *fimbriatum, Asplenium varians, Asplenium vastum, Asplenium venturae, Asplenium venulosum, Asplenium verapax, Asplenium vesiculosum, Asplenium vespertinum, Asplenium villosum, Asplenium virens, Asplenium viride, Asplenium viridifrons, Asplenium virillae, Asplenium viviparioides, Asplenium viviparum, Asplenium viviparum* var *viviparum, Asplenium viviparum* var. *lineatu, Asplenium volubile, Asplenium vulcanicum, Asplenium wacketii, Asplenium wagneri, Asplenium wallichianum, Asplenium warneckei, Asplenium wilfordii, Asplenium williamsii, Asplenium wrightii, Asplenium wrightioides, Asplenium wuliangshanense, Asplenium xianqianense, Asplenium xinjiangense, Asplenium xinyiense, Asplenium yelagagense, Asplenium yoshinagae, Asplenium yunnanense, Asplenium zamiifolium, Asplenium zanzibaricum, Asplenium biscayneanum, Asplenium curtissii, Asplenium ebenoides, Asplenium herb-wagneri, Asplenium heteroresiliens, Asplenium kenzoi, Asplenium plenum, Asplenium wangii,* and *Asplenium×clermontiae, Asplenium×gravesii.*

In some embodiments the PtIP-65 polypeptide is derived from a fern species in the Order Polypodiales, Family Blechnaceae, Genus *Blechnum* L. In some embodiments the PtIP-65 polypeptide is derived from a fern species in the Order Polypodiales, Family Blechnaceae, Genus *Blechnum* L. selected from but not limited to *Blechnum amabile, Blechnum appendiculatum, Blechnum articulatum, Blechnum australe, Blechnum austrobrasilianum, Blechnum binervatum, Blechnum blechnoides, Blechnum brasiliense, Blechnum capense, Blechnum cartilagineum, Blechnum castaneum, Blechnum chambersii, Blechnum chilense, Blechnum colensoi, Blechnum contiguum, Blechnum cordatum, Blechnum coriaceum, Blechnum discolor, Blechnum doodioides, Blechnum durum, Blechnum eburneum, Blechnum ensiforme, Blechnum filiforme, Blechnum fluviatile, Blechnum fragile, Blechnum fraseri, Blechnum fullagari, Blechnum gibbum, Blechnum glandulosum, Blechnum gracile, Blechnum hancockii, Blechnum hastatum, Blechnum howeanum, Blechnum indicum, Blechnum kunthianum, Blechnum laevigatum, Blechnum loxense, Blechnum magellanicum, Blechnum membranaceum, Blechnum microbasis, Blechnum microphyllum, Blechnum milnei, Blechnum minus, Blechnum mochaenum, Blechnum montanum, Blechnum moorei, Blechnum moritzianum, Blechnum nigrum, Blechnum niponicum, Blechnum norfolkianum, Blechnum novae-zelandiae, Blechnum nudum, Blechnum obtusatum, Blechnum occidentale, Blechnum oceanicum, Blechnum orientale, Blechnum patersonii, Blechnum penna-marina, Blechnum polypodioides, Blechnum procerum, Blechnum punctulatum, Blechnum sampaioanum, Blechnum schiedeanum, Blechnum schomburgkii, Blechnum serrulatum, Blechnum simillimum, Blechnum spicant, Blechnum stipitellatum, Blechnum tabulare, Blechnum triangularifolium, Blechnum vieillardii, Blechnum vulcanicum, Blechnum wattsii, Blechnum whelanii,* and *Blechnum wurunuran.*

In some embodiments the PtIP-65 polypeptide is derived from a fern species in the Order Polypodiales, Family Dryopteridaceae Genus *Acrophorus,* Genus *Acrorumohra,* Genus *Anapausia,* Genus *Arachniodes,* Genus *Bolbitis,* Genus *Ctenitis,* Genus *Cyclodium,* Genus *Cyrtogonellum,* Genus *Cyrtomidictyum,* Genus *Cyrtomium,* Genus *Diacalpe,* Genus *Didymochlaena,* Genus *Dryopsis,* Genus *Dryopteris,* Genus *Elaphoglossum,* Genus *Hypodematium,* Genus *Lastreopsis,* Genus *Leptorumohra,* Genus *Leucostegia,* Genus *Lithostegia,* Genus *Lomagramma,* Genus *Maxonia,* Genus *Megalastrum,* Genus *Olfersia,* Genus *Peranema,* Genus *Phanerophlebia,* Genus *Phanerophlebiopsis,* Genus *Polybotrya,* Genus *Polystichopsis,* Genus *Polystichum,* Genus *Rumohra,* Genus *Sorolepidium,* Genus *Stigmatopteris* or Genus *Teratophyllum.* In some embodiments the PtIP-65 polypeptide is derived from a fern species in the Order Polypodiales, Family Dryopteridaceae, Genus *Bolbitis,* selected from but not limited to *Bolbitis acrostichoides, Bolbitis aliena, Bolbitis angustipinna, Bolbitis appendiculata, Bolbitis auriculata, Bolbitis bemoullii, Bolbitis bipinnatifida, Bolbitis cadieri, Bolbitis christensenfi, Bolbitis confertifolia, Bolbitis costata, Bolbitis crispatula, Bolbitis fluviatilis, Bolbitis gaboonensis, Bolbitis gemmifera, Bolbitis hainanensis, Bolbitis hastata, Bolbitis hekouensis, Bolbitis hemiotis, Bolbitis heteroclita, Bolbitis heudelotii, Bolbitis humblotii, Bolbitis interlineata, Bolbitis latipinna, Bolbitis laxireticulate, Bolbitis lindigfi, Bolbitis lonchophora, Bolbitis longiflagellata, Bolbitis major, Bolbitis media, Bolbitis nicotianifolia, Bolbitis nodiflora, Bolbitis novoguineensis, Bolbitis oligarchica, Bolbitis palustris, Bolbitis pandurifolia, Bolbitis pergamentacea, Bolbitis portoricensis, Bolbitis presliana, Bolbitis quoyana, Bolbitis rawsonfi, Bolbitis repanda, Bolbitis rhizophylla, Bolbitis riparia, Bolbitis rivularis, Bolbitis sagenioides, Bolbitis salicina, Bolbitis scalpturata, Bolbitis scandens, Bolbitis semicordata, Bolbitis semipinnatifida, Bolbitis serrata, Bolbitis serratifolia, Bolbitis simplex, Bolbitis sinensis, Bolbitis singaporensis, Bolbitis sinuata, Bolbitis subcordata, Bolbitis subcrenata, Bolbitis taylorii, Bolbitis tibetica, Bolbitis tonkinensis, Bolbitis umbrosa, Bolbitis vanuaensis,* and *Bolbitis virens.*

In some embodiments the PtIP-65 polypeptide is derived from a fern species in the Order Polypodiales, Family Lomariopsidaceae, Genus *Nephrolepis.* In some embodiments the PtIP-65 polypeptide is derived from a fern species in the Order Polypodiales, Family Lomariopsidaceae, Genus *Nephrolepis* is selected from but not limited to *Nephrolepis abrupta, Nephrolepis acuminata, Nephrolepis acutifolia, Nephrolepis arida, Nephrolepis arthropteroides, Nephrolepis biserrata* var. *auriculata, Nephrolepis brownii, Nephrolepis celebica, Nephrolepis clementis, Nephrolepis cordifolia, Nephrolepis davalliae, Nephrolepis davallioides, Nephrolepis dayakorum, Nephrolepis delicatula, Nephrolepis dicksonioides, Nephrolepis duffii, Nephrolepis exaltate* ssp. *exaltate* ssp. *Hawaiiensis, Nephrolepis falcate, Nephrolepis falciformis, Nephrolepis glabra, Nephrolepis hirsutula, Nephrolepis humatoides, Nephrolepis iridescens, Nephrolepis kurotawae, Nephrolepis laurifolia, Nephrolepis lauterbachii, Nephrolepis lindsayae, Nephrolepis multifida, Nephrolepis multiflora, Nephrolepis niphoboloides, Nephrolepis obliterate, Nephrolepis paludosa, Nephrolepis pectinate, Nephrolepis pendula, Nephrolepis persicifolia, Nephrolepis pickelii, Nephrolepis pilosula, Nephrolepis pubescens, Nephrolepis pumicicola, Nephrolepis radicans, Nephrolepis rivularis, Nephrolepis rosenstockii, Nephrolepis saligna, Nephrolepis schlechteri, Nephrolepis serrate, Nephrolepis thomsoni, Nephrolepis undulate* var. *aureoglandulosa, Nephrolepis×averyi, Nephrolepis×copelandii,* and *Nephrolepis×medlerae.*

In some embodiments the PtIP-65 polypeptide is derived from a fern species in the Order Polypodiales, Family Polypodiaceae, Genus *Campyloneurum,* Genus *Drynaria,* Genus *Lepisorus,* Genus *Microgramma,* Genus *Microsorum,* Genus *Neurodium,* Genus *Niphidium,* Genus *Pecluma* M.G., Genus *Phlebodium,* Genus *Phymatosorus,* Genus *Platycerium,* Genus *Pleopeltis,* Genus *Polypodium* L.

In some embodiments the PtIP-65 polypeptide is derived from a fern species in the Order Polypodiales, Family Polypodiaceae, Genus *Polypodium* L. In some embodiments the PtIP-65 polypeptide is derived from a fern species in the Order Polypodiales, Family Polypodiaceae, Genus *Polypodium* L. selected from but not limited to *Polypodium absidatum, Polypodium acutifolium, Polypodium adiantiforme, Polypodium aequale, Polypodium affine, Polypodium albidopaleatum, Polypodium alcicorne, Polypodium alfarii, Polypodium alfredii, Polypodium alfredii* var. *curtii, Polypodium allosuroides, Polypodium alsophilicola, Polypodium amamianum, Polypodium amoenum, Polypodium amorphum, Polypodium anetioides, Polypodium anfractuosum, Polypodium anguinum, Polypodium angustifolium* f. *remotifolia, Polypodium angustifolium* var. *amphostenon, Polypodium angustifolium* var. *heterolepis, Polypodium angustifolium* var. *monstrosa, Polypodium angustipaleatum, Polypodium angustissimum, Polypodium anisomeron* var. *pectinatum, Polypodium antioquianum, Polypodium aoristisorum, Polypodium apagolepis, Polypodium apicidens, Polypodium apiculatum, Polypodium apoense, Polypodium appalachianum, Polypodium appressum, Polypodium arenarium, Polypodium argentinum, Polypodium argutum, Polypodium armatum, Polypodium aromaticum, Polypodium aspersum, Polypodium assurgens, Polypodium atrum, Polypodium auriculatum, Polypodium balaonense, Polypodium balliviani, Polypodium bamleri, Polypodium bangii, Polypodium bartlettii, Polypodium basale, Polypodium bemoullii, Polypodium biauritum, Polypodium bifrons, Polypodium blepharodes, Polypodium bolivari, Polypodium bolivianum, Polypodium bolobense, Polypodium bombycinum, Polypodium bombycinum* var. *insularum, Polypodium bradeorum, Polypodium bryophilum, Polypodium bryopodum, Polypodium buchtienii, Polypodium buesii, Polypodium bulbotrichum, Polypodium caceresii, Polypodium californicum* f. *brauscombii, Polypodium californicum* f. *parsonsiae, Polypodium californicum, Polypodium calophlebium, Polypodium calvum, Polypodium camptophyllarium* var. *abbreviatum, Polypodium capitellatum, Polypodium carpinterae, Polypodium chachapoyense, Polypodium chartaceum, Polypodium chimantense, Polypodium chiricanum, Polypodium choquetangense, Polypodium christensenii, Polypodium christii, Polypodium chrysotrichum, Polypodium ciliolepis, Polypodium cinerascens, Polypodium collinsii, Polypodium colysoides, Polypodium confluens, Polypodium conforme, Polypodium confusum, Polypodium congregatifolium, Polypodium connellii, Polypodium consimile* var. *bourgaeanum, Polypodium consimile* var. *minor, Polypodium conterminans, Polypodium contiguum, Polypodium cookii, Polypodium coriaceum, Polypodium coronans, Polypodium costaricense, Polypodium costatum, Polypodium crassifolium* f. *angustissimum, Polypodium crassifolium* var. *longipes, Polypodium crassulum, Polypodium craterisorum, Polypodium cryptum, Polypodium crystalloneuron, Polypodium cucullatum* var. *planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeraranum, Polypodium denticulatum, Polypodium diaphanum, Polypodium dilatatum, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis* var. *villosum, Polypodium exornans, Polypodium falcoideum, Polypodium fallacissimum, Polypodium farinosum, Polypodium faucium, Polypodium feel, Polypodium ferrugineum, Polypodium feuillei, Polypodium firmulum, Polypodium firmum, Polypodium flaccidum, Polypodium flagellare, Polypodium flexuosum, Polypodium flexuosum* var. *ekmanii, Polypodium forbesii, Polypodium formosanum, Polypodium fraxinifolium* subsp. *articulatum, Polypodium fraxinifolium* subsp. *luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum* var. *simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens* var. *subdentatum, Polypodium insidiosum, Polypodium insigne, Polypodium intermedium* subsp. *masafueranum* var. *obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri* var. *costaricense, Polypodium lachniferum* f. *incurvata, Polypodium lachniferum* var. *glabrescens, Polypodium lachnopus, Polypodium lanceolaturn* var. *cornplanatum, Polypodium lanceolaturn* var. *trichophorum, Polypodium latevagans, Polypodium laxifrons, Polypodium laxifrons* var. *lividum, Polypodium lehmannianum, Polypodium leiorhizum, Polypodium leptopodon, Polypodium leuconeuron* var. *angustifolia, Polypodium leuconeuron* var. *latifolium, Polypodium leucosticta, Polypodium limulum, Polypodium lindigii, Polypodium lineatum, Polypodium lomarioides, Polypodium longifrons, Polypodium loretense, Polypodium loriceum* var. *umbraticum, Polypodium loriforme, Polypodium loxogramme* f. *gigas, Polypodium ludens, Polypodium luzonicum, Polypodium lycopodioides* f. *obtusum, Polypodium lycopodioides* L., *Polypodium macrolepis, Polypodium macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalolepis, Polypodium melanotrichum, Polypodium menisciifolium* var. *pubescens, Polypodium meniscioides, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme* var. *minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum* var. *latior, Polypodium nubrige-* num, *Polypodium oligolepis*, *Polypodium oligosorum*, *Polypodium oligosorum*, *Polypodium olivaceum*, *Polypodium olivaceum* var. *elatum*, *Polypodium oodes*, *Polypodium oosphaerum*, *Polypodium oreophilum*, *Polypodium omatissimum*, *Polypodium ornatum*, *Polypodium ovatum*, *Polypodium oxylobum*, *Polypodium oxypholis*, *Polypodium pakkaense*, *Polypodium pallidum*, *Polypodium palmatopedatum*, *Polypodium palmeri*, *Polypodium panamense*, *Polypodium parvum*, *Polypodium patagonicum*, *Polypodium paucisorum*, *Polypodium pavonianum*, *Polypodium pectinatum* var. *caliense*, *Polypodium pectinatum* var. *hispidum*, *Polypodium pellucidum*, *Polypodium pendulum* var. *boliviense*, *Polypodium percrassum*, *Polypodium perpusillum*, *Polypodium peruvianum* var. *subgibbosum*, *Polypodium phyllitidis* var. *elongatum*, *Polypodium pichinchense*, *Polypodium pilosissimum*, *Polypodium pilosissimum* var. *glabriusculum*, *Polypodium pilossimum* var. *tunguraquensis*, *Polypodium pityrolepis*, *Polypodium platyphyllum*, *Polypodium playfairii*, *Polypodium plebeium* var. *cooperi*, *Polypodium plectolepidioides*, *Polypodium pleolepis*, *Polypodium plesiosorum* var.i, *Polypodium podobasis*, *Polypodium podocarpum*, *Polypodium poloense*, *Polypodium polydatylon*, *Polypodium polypodioides* var. *aciculare*, *Polypodium polypodioides* var. *michauxianum*, *Polypodium praetermissum*, *Polypodium preslianum* var. *immersum*, *Polypodium procerum*, *Polypodium procerum*, *Polypodium productum*, *Polypodium productum*, *Polypodium prolongilobum*, *Polypodium propinguum*, *Polypodium proteus*, *Polypodium pruinatum*, *Polypodium pseudocapillare*, *Polypodium pseudofratemum*, *Polypodium pseudonutans*, *Polypodium pseudoserratum*, *Polypodium pulcherrimum*, *Polypodium pulogense*, *Polypodium pungens*, *Polypodium purpusii*, *Polypodium radicale*, *Polypodium randallii*, *Polypodium ratiborii*, *Polypodium reclinaturn*, *Polypodium recreense*, *Polypodium repens* var. *abruptum*, *Polypodium revolvens*, *Polypodium rhachipterygium*, *Polypodium rhomboideum*, *Polypodium rigens*, *Polypodium robustum*, *Polypodium roraimense*, *Polypodium roraimense*, *Polypodium rosei*, *Polypodium rosenstockii*, *Polypodium rubidum*, *Polypodium rudimentum*, *Polypodium rusbyi*, *Polypodium sablanianum*, *Polypodium sarmentosum*, *Polypodium saxicola*, *Polypodium schenckii*, *Polypodium schlechteri*, *Polypodium scolopendria*, *Polypodium scolopendria*, *Polypodium scolopendrium*, *Polypodium scouleri*, *Polypodium scutulatum*, *Polypodium segregatum*, *Polypodium semihirsutum*, *Polypodium semihirsutum* var. *fuscosetosum*, *Polypodium senile* var. *minor*, *Polypodium sericeolanatum*, *Polypodium serraeforme*, *Polypodium serricula*, *Polypodium sesquipedala*, *Polypodium sessilifolium*, *Polypodium setosum* var. *calvum*, *Polypodium setulosum*, *Polypodium shaferi*, *Polypodium sibomense*, *Polypodium siccum*, *Polypodium simacense*, *Polypodium simulans*, *Polypodium singeri*, *Polypodium sinicum*, *Polypodium sintenisii*, *Polypodium skutchii*, *Polypodium sloanei*, *Polypodium sodiroi*, *Polypodium sordidulum*, *Polypodium sordidum*, *Polypodium sphaeropteroides*, *Polypodium sphenodes*, *Polypodium sprucei*, *Polypodium sprucei* var. *furcativenosa*, *Polypodium steirolepis*, *Polypodium stenobasis*, *Polypodium stenolepis*, *Polypodium stenopterum*, *Polypodium subcapillare*, *Polypodium subflabelliforme*, *Polypodium subhemionitidium*, *Polypodium subinaequale*, *Polypodium subintegrum*, *Polypodium subspathulatum*, *Polypodium subtile*, *Polypodium subvestitum*, *Polypodium subviride*, *Polypodium superficiale* var. *attenuatum*, *Polypodium superficiale* var. *chinensis*, *Polypodium sursumcurrens*, *Polypodium tablazianurn*, *Polypodium taenifolium*, *Polypodium tamandarei*, *Polypodium tatei*, *Polypodium tenuiculum* var. *acrosora*, *Polypodium tenuiculum* var. *brasiliense*, *Polypodium tenuilore*, *Polypodium tenuinerve*, *Polypodium tepuiense*, *Polypodium teresae*, *Polypodium tetragonum* var. *incompletum*, *Polypodium thysanolepis* var. *bipinnatifidum*, *Polypodium thyssanolepis*, var. *thyssanolepis*, *Polypodium thyssanolepsi*, *Polypodium tobagense*, *Polypodium trichophyllum*, *Polypodium tridactylum*, *Polypodium tridentatum*, *Polypodium trifurcaturn* var. *brevipes*, *Polypodium triglossum*, *Polypodium truncatulum*, *Polypodium truncicola* var. *major*, *Polypodium truncicola* var. *minor*, *Polypodium tuberosum*, *Polypodium tunguraguae*, *Polypodium turquinurn*, *Polypodium turrialbae*, *Polypodium ursipes*, *Polypodium vegans*, *Polypodium valdealaturn*, *Polypodium versteegii*, *Polypodium villagranii*, *Polypodium virginianum* f. *cambroideum*, *Polypodium virginianurn* f. *peraferens*, *Polypodium vittarioides*, *Polypodium vulgare*, *Polypodium vulgare* L., *Polypodium vulgare* subsp. *oreophilum*, *Polypodium vulgare* var. *acuminatum*, *Polypodium vulpinum*, *Polypodium williamsii*, *Polypodium wobbense*, *Polypodium×fallacissimum-guttatum*, *Polypodium xantholepis*, *Polypodium xiphopteris*, *Polypodium yarumalense*, *Polypodium yungense*, and *Polypodium zosteriforme*.

In some embodiments the PtIP-65 polypeptide is derived from a fern species in the Order Polypodiales, Family Polypodiaceae, Genus *Platycerium*. In some embodiments the PtIP-65 polypeptide is derived from a fern species in the Order Polypodiales, Family Polypodiaceae, Genus *Platycerium* selected from but not limited to *Platycerium alcicorne*, *Platycerium andinum*, *Platycerium angolense*, *Platycerium bifurcatum*, *Platycerium coronarium*, *Platycerium elephantotis*, *Platycerium ellisii*, *Platycerium grande*, *Platycerium hillii*, *Platycerium holttumfi*, *Platycerium madagascariense*, *Platycerium quadridichotomum*, *Platycerium ridleyi*, *Platycerium* sp. ES-2011, *Platycerium stemaria*, *Platycerium superbum*, *Platycerium veitchii*, *Platycerium wallichii*, *Platycerium wandae*, *Platycerium wilhelminae-reginae*, and *Platycerium willinckii*.

In some embodiments the PtIP-65 polypeptide is derived from a species in the Division Lycophyta.

In some embodiments the PtIP-65 polypeptide is derived from a species in the Division Lycophyta, Class Isoetopsida or Class Lycopodiopsida.

In some embodiments the PtIP-65 polypeptide is derived from a species in the Class Isoetopsida Order Selaginales. In some embodiments the PtIP-65 polypeptide is derived from a fern species in the Class Isoetopsida, Order Selaginales, Family Selaginellaceae. In some embodiments the PtIP-65 polypeptide is derived from a species in the Genus *Selaginella*. In some embodiments the PtIP-65 polypeptide is derived from a *Selaginella* species selected from but not limited to *Selaginella acanthonota*, *Selaginella apoda*, *Selaginella arbuscula*, *Selaginella arenicola*, *Selaginella arizonica*, *Selaginella armata*, *Selaginella asprella*, *Selaginella biformis*, *Selaginella bigelovii*, *Selaginella braunii*, *Selaginella cinerascens*, *Selaginella cordifolia*, *Selaginella deflexa*, *Selaginella delicatula*, *Selaginella densa*, *Selaginella douglasii*, *Selaginella eatonii*, *Selaginella eclipes*, *Selaginella eremophila*, *Selaginella erythropus*, *Selaginella flabellata*, *Selaginella hansenii*, *Selaginella heterodonta*, *Selaginella kraussiana*, *Selaginella krugii*, *Selaginella laxifolia*, *Selaginella lepidophylla*, *Selaginella leucobryoides*, *Selaginella ludoviciana*, *Selaginella mutica*, *Selaginella oregana*, *Selaginella ovifolia*, *Selaginella pallescens*, *Selaginella peruviana*, *Selaginella pilifera*, *Selaginella plana*, *Selaginella plumosa*, *Selaginella pulcherrima*, *Selaginella rupestris*, *Selaginella rupincola*, *Selaginella scopulorum*, *Selaginella selaginoides*, *Selaginella sibirica*, *Selaginella*

*standleyi, Selaginella stellata, Selaginella subcaulescens, Selaginella substipitata, Selaginella tenella, Selaginella tortipila, Selaginella uliginosa, Selaginella umbrosa, Selaginella uncinata, Selaginella underwoodii, Selaginella utahensis, Selaginella victoriae, Selaginella viridissima, Selaginella wallacei, Selaginella watsonii, Selaginella weatherbiana, Selaginella willdenowii, Selaginella wrightii* and *Selaginella×neomexicana.*

In some embodiments the PtIP-65 polypeptide is derived from a species in the Class Lycopodiopsida, Order Lycopodiales. In some embodiments the PtIP-65 polypeptide is derived from a fern species in the Class Lycopodiopsida, Order Lycopodiales Family Lycopodiaceae or Family Huperziaceae. In some embodiments the PtIP-65 polypeptide is derived from a species in the Genus *Austrolycopodium, Dendrolycopodium, Diphasiastrum, Diphasium, Huperzia, Lateristachys, Lycopodiastrum, Lycopodiella, Lycopodium, Palhinhaea, Pseudodiphasium, Pseudolycopodiella, Pseudolycopodium* or *Spinulum.*

In some embodiments the PtIP-65 polypeptide is derived from a species in the Genus *Lycopodium.* In some embodiments the PtIP-65 polypeptide is derived from a *Lycopodium* species selected from but not limited to *Lycopodium alpinum* L., *Lycopodium annotinum* L., *Lycopodium clavatum* L., *Lycopodium complanatum* L., *Lycopodium dendroideum* Michx., *Lycopodium digitatum, Lycopodium xhabereri, Lycopodium hickeyi, Lycopodium×issleri, Lycopodium lagopus, Lycopodium obscurum* L., *Lycopodium phlegmaria* L., *Lycopodium sabinifolium, Lycopodium sitchense, Lycopodium tristachyum, Lycopodium venustulum, Lycopodium venustulum* var. *venustulum, Lycopodium venustulum* var. *verticale, Lycopodium volubile* and *Lycopodium×zeilleri.*

In some embodiments the PtIP-65 polypeptide is derived from a species in the Genus *Huperzia.* In some embodiments the PtIP-65 polypeptide is derived from a species selected from but not limited to *Huperzia appressa, Huperzia arctica, Huperzia attenuata, Huperzia australiana, Huperzia balansae, Huperzia billardierei, Huperzia brassii, Huperzia campiana, Huperzia capellae, Huperzia carinata, Huperzia* cf. *carinata* ARF000603, *Huperzia* cf. *nummulariifolia* ARF001140, *Huperzia* cf. *phlegmaria* ARF000717, *Huperzia* cf. *phlegmaria* ARF000771, *Huperzia* cf. *phlegmaria* ARF000785, *Huperzia* cf. *phlegmaria* ARF001007, *Huperzia* cf. *phlegmaria* ARF002568, *Huperzia* cf. *phlegmaria* ARF002703, *Huperzia* cf. *phlegmaria* Wikstrom 1998, *Huperzia chinensis, Huperzia compacta, Huperzia crassa, Huperzia crispata, Huperzia cryptomeriana, Huperzia cumingii, Huperzia dacrydioides, Huperzia dalhousieana, Huperzia dichotoma, Huperzia emeiensis, Huperzia ericifolia, Huperzia eversa, Huperzia fargesii, Huperzia fordii, Huperzia funiformis, Huperzia goebellii, Huperzia haleakalae, Huperzia hamiltonii, Huperzia heteroclita, Huperzia hippuridea, Huperzia hippuris, Huperzia holstii, Huperzia horizontalis, Huperzia hunanensis, Huperzia hystrix, Huperzia lindenii, Huperzia linifolia, Huperzia lockyeri, Huperzia lucidula, Huperzia mingcheensis, Huperzia miyoshiana, Huperzia nanchuanensis, Huperzia nummulariifolia, Huperzia obtusifolia, Huperzia ophioglossoides, Huperzia petiolata, Huperzia phlegmaria, Huperzia phlegmarioides, Huperzia phyllantha, Huperzia pinifolia, Huperzia polydactyla, Huperzia prolifera, Huperzia reflexa, Huperzia rosenstockiana, Huperzia rufescens, Huperzia salvinoides, Huperzia sarmentosa, Huperzia selago, Huperzia serrata, Huperzia sieboldii, Huperzia somae, Huperzia squarrosa, Huperzia subulata, Huperzia sutchueniana, Huperzia tauri, Huperzia taxifolia, Huperzia tenuis, Huperzia tetragona, Huperzia tetrasticha, Huperzia unguiculata, Huperzia varia, Huperzia verticillata* and *Huperzia wilsonii.*

In some embodiments the PtIP-65 polypeptide comprises at least one of the amino acid sequence motifs as shown in Table 3.

TABLE 3

|  |  | Motif 12 | Motif 2 | Motif 19 | Motif 6 | Motif 17 | Motif 1 | Motif 10 |
|---|---|---|---|---|---|---|---|---|
| PtIP-65Gc | SEQ ID NO: 27 | 2-17 | 18-48 | 49-60 | 61-76 | n.i. | 77-119 | n.i. |
| PtIP-65Ha | SEQ ID NO: 25 | 2-17 | 18-48 | 49-60 | 61-76 | n.i. | 77-119 | n.i. |
| PtIP-65Gd | SEQ ID NO: 35 | 2-17 | 18-48 | 49-60 | 61-76 | n.i. | 77-119 | n.i. |
| PtIP-65Ge | SEQ ID NO: 36 | 2-17 | 18-48 | 49-60 | 61-76 | n.i. | 77-119 | n.i. |
| PtIP-65Ga | SEQ ID NO: 30 | 2-17 | 18-48 | 49-60 | 61-76 | n.i. | 77-119 | n.i. |
| PtIP-65Gb | SEQ ID NO: 34 | 2-17 | 18-48 | 49-60 | 61-76 | n.i. | 77-119 | n.i. |
| PtIP-65Hj | SEQ ID NO: 39 | 2-17 | 18-48 | 49-60 | 62-77 | n.i. | 78-120 | n.i. |
| PtIP-65Hk | SEQ ID NO: 37 | n.i. | n.i. | n.i. | 63-77 | n.i. | n.i. | n.i. |
| PtIP-65Hg | SEQ ID NO: 40 | 82-97 | 98-128 | n.i. | 141-156 | n.i. | 157-199 | n.i. |
| PtIP-65Hh | SEQ ID NO: 38 | 41-56 | 57-87 | n.i. | 103-118 | n.i. | 119-161 | n.i. |
| PtIP-65Fa | SEQ ID NO: 41 | 1-16 | 18-48 | n.i. | 67-82 | 50-65 | 83-125 | n.i. |
| PtIP-65Fb | SEQ ID NO: 42 | 1-16 | 18-48 | n.i. | 67-82 | 50-65 | 83-125 | n.i. |
| PtIP-65Ca | SEQ ID NO: 29 | 0-15 | 16-46 | n.i. | 65-80 | 48-63 | 81-123 | n.i. |
| PtIP-65Aa | SEQ ID NO: 22 | 0-15 | 16-46 | n.i. | 65-80 | 48-63 | 81-123 | n.i. |
| PtIP-65Ba | SEQ ID NO: 24 | 0-15 | 16-46 | n.i. | 65-80 | 48-63 | 81-123 | n.i. |
| PtIP-65Bb | SEQ ID NO: 26 | 0-15 | 16-46 | n.i. | 65-80 | 48-63 | 81-123 | n.i. |
| PtIP-65He | SEQ ID NO: 32 | n.i. | 16-46 | 47-58 | 60-75 | n.i. | n.i. | 86-127 |
| PtIP-65Hf | SEQ ID NO: 33 | n.i. | 22-52 | 53-64 | 66-81 | n.i. | n.i. | 93-134 |
| PtIP-65Hb | SEQ ID NO: 31 | n.i. | 21-51 | 52-63 | 64-79 | n.i. | n.i. | 95-136 |
| PtIP-65Hc | SEQ ID NO: 23 | n.i. | 23-53 | 54-65 | 66-81 | n.i. | n.i. | 97-138 |
| PtIP-65Hd | SEQ ID NO: 28 | n.i. | 23-53 | 54-65 | 66-81 | n.i. | n.i. | 98-139 |

|  |  | Motif 16 | Motif 3 | Motif 15 | Motif 27 | Motif 7 | Motif 11 | Motif 21 |
|---|---|---|---|---|---|---|---|---|
| PtIP-65Gc | SEQ ID NO: 27 | 120-128 | 129-159 | 161-172 | n.i. | 175-204 | n.i. | n.i. |
| PtIP-65Ha | SEQ ID NO: 25 | 120-128 | 129-159 | 161-172 | n.i. | 175-204 | n.i. | n.i. |
| PtIP-65Gd | SEQ ID NO: 35 | 120-128 | 129-159 | 161-172 | n.i. | 175-204 | n.i. | n.i. |
| PtIP-65Ge | SEQ ID NO: 36 | 120-128 | 129-159 | 161-172 | n.i. | 175-204 | n.i. | n.i. |
| PtIP-65Ga | SEQ ID NO: 30 | 120-128 | 129-159 | 161-172 | n.i. | 175-204 | n.i. | n.i. |
| PtIP-65Gb | SEQ ID NO: 34 | 120-128 | 129-159 | 161-172 | n.i. | 175-204 | n.i. | n.i. |
| PtIP-65Hj | SEQ ID NO: 39 | 121-129 | 130-160 | 162-173 | n.i. | 176-207 | n.i. | n.i. |
| PtIP-65Hk | SEQ ID NO: 37 | n.i. | 133-163 | 164-175 | n.i. | 179-208 | n.i. | n.i. |

TABLE 3-continued

|  |  | | | | | | | |
|---|---|---|---|---|---|---|---|---|
| PtIP-65Hg | SEQ ID NO: 40 | 200-208 | 209-239 | 241-252 | n.i. | n.i. | n.i. | n.i. |
| PtIP-65Hh | SEQ ID NO: 38 | 162-170 | n.i. | 204-215 | n.i. | 217-246 | n.i. | n.i. |
| PtIP-65Fa | SEQ ID NO: 41 | 126-134 | 135-165 | 167-178 | n.i. | 180-209 | n.i. | n.i. |
| PtIP-65Fb | SEQ ID NO: 42 | 126-134 | 135-165 | 167-178 | n.i. | 180-209 | n.i. | n.i. |
| PtIP-65Ca | SEQ ID NO: 29 | 124-132 | 133-163 | n.i. | n.i. | n.i. | 182-222 | n.i. |
| PtIP-65Aa | SEQ ID NO: 22 | 124-132 | 133-163 | n.i. | n.i. | n.i. | 182-222 | n.i. |
| PtIP-65Ba | SEQ ID NO: 24 | 124-132 | 133-163 | n.i. | n.i. | n.i. | 182-222 | n.i. |
| PtIP-65Bb | SEQ ID NO: 26 | 124-132 | 133-163 | n.i. | n.i. | n.i. | 182-222 | n.i. |
| PtIP-65He | SEQ ID NO: 32 | n.i. | 131-161 | n.i. | 169-177 | 178-207 | n.i. | 217-238 |
| PtIP-65Hf | SEQ ID NO: 33 | n.i. | 137-167 | n.i. | 175-183 | 184-213 | n.i. | 223-244 |
| PtIP-65Hb | SEQ ID NO: 31 | n.i. | 139-169 | n.i. | 177-185 | 186-215 | n.i. | 222-243 |
| PtIP-65Hc | SEQ ID NO: 23 | n.i. | 141-171 | n.i. | 178-186 | 187-216 | n.i. | 225-246 |
| PtIP-65Hd | SEQ ID NO: 28 | n.i. | 142-172 | n.i. | 179-187 | 188-217 | n.i. | 226-247 |

|  |  | Motif 5 | Motif 20 | Motif 26 | Motif 23 | Motif 18 | Motif 4 |
|---|---|---|---|---|---|---|---|
| PtIP-65Gc | SEQ ID NO: 27 | 206-236 | n.i. | n.i. | 239-250 | n.i. | 251-300 |
| PtIP-65Ha | SEQ ID NO: 25 | 206-236 | n.i. | n.i. | 239-250 | n.i. | 251-300 |
| PtIP-65Gd | SEQ ID NO: 35 | 206-236 | n.i. | n.i. | 239-250 | n.i. | 251-300 |
| PtIP-65Ge | SEQ ID NO: 36 | 206-236 | n.i. | n.i. | 239-250 | n.i. | 251-300 |
| PtIP-65Ga | SEQ ID NO: 30 | 206-236 | n.i. | n.i. | 239-250 | n.i. | 251-300 |
| PtIP-65Gb | SEQ ID NO: 34 | 206-236 | n.i. | n.i. | 239-250 | n.i. | 251-300 |
| PtIP-65Hj | SEQ ID NO: 39 | 207-237 | n.i. | n.i. | 240-251 | n.i. | 252-301 |
| PtIP-65Hk | SEQ ID NO: 37 | 210-240 | n.i. | n.i. | n.i. | n.i. | n.i. |
| PtIP-65Hg | SEQ ID NO: 40 | 285-315 | n.i. | n.i. | n.i. | n.i. | 330-379 |
| PtIP-65Hh | SEQ ID NO: 38 | 248-278 | n.i. | 307-322 | n.i. | n.i. | n.i. |
| PtIP-65Fa | SEQ ID NO: 41 | 211-241 | n.i. | n.i. | n.i. | n.i. | 256-305 |
| PtIP-65Fb | SEQ ID NO: 42 | 211-241 | n.i. | n.i. | n.i. | n.i. | 256-305 |
| PtIP-65Ca | SEQ ID NO: 29 | 229-259 | 260-288 | 291-306 | n.i. | n.i. | n.i. |
| PtIP-65Aa | SEQ ID NO: 22 | 229-259 | 260-288 | 290-305 | n.i. | n.i. | n.i. |
| PtIP-65Ba | SEQ ID NO: 24 | n.i. | 261-289 | 291-306 | n.i. | n.i. | n.i. |
| PtIP-65Bb | SEQ ID NO: 26 | 229-259 | 260-288 | 290-305 | n.i. | n.i. | n.i. |
| PtIP-65He | SEQ ID NO: 32 | n.i. | n.i. | n.i. | n.i. | 241-262 | n.i. |
| PtIP-65Hf | SEQ ID NO: 33 | n.i. | n.i. | n.i. | n.i. | 247-268 | n.i. |
| PtIP-65Hb | SEQ ID NO: 31 | n.i. | n.i. | n.i. | n.i. | 245-266 | n.i. |
| PtIP-65Hc | SEQ ID NO: 23 | n.i. | n.i. | V | n.i. | 248-269 | n.i. |
| PtIP-65Hd | SEQ ID NO: 28 | n.i. | n.i. | n.i. | n.i. | 249-270 | n.i. |

|  |  | Motif 24 | Motif 13 | Motif 22 | Motif 9 | Motif 14 | Motif 8 |
|---|---|---|---|---|---|---|---|
| PtIP-65Gc | SEQ ID NO: 27 | n.i. | 302-317 | 319-330 | n.i. | n.i. | 332-353 |
| PtIP-65Ha | SEQ ID NO: 25 | n.i. | 302-317 | 319-330 | n.i. | n.i. | 332-353 |
| PtIP-65Gd | SEQ ID NO: 35 | n.i. | 302-317 | 318-329 | n.i. | n.i. | 331-352 |
| PtIP-65Ge | SEQ ID NO: 36 | n.i. | 302-317 | 318-329 | n.i. | n.i. | 331-352 |
| PtIP-65Ga | SEQ ID NO: 30 | n.i. | 302-317 | 318-329 | n.i. | n.i. | 332-353 |
| PtIP-65Gb | SEQ ID NO: 34 | n.i. | 302-317 | 318-329 | n.i. | n.i. | 332-353 |
| PtIP-65Hj | SEQ ID NO: 39 | n.i. | 303-318 | n.i. | n.i. | n.i. | n.i. |
| PtIP-65Hk | SEQ ID NO: 37 | n.i. | n.i. | n.i. | n.i. | n.i. | n.i. |
| PtIP-65Hg | SEQ ID NO: 40 | n.i. | n.i. | n.i. | n.i. | n.i. | n.i. |
| PtIP-65Hh | SEQ ID NO: 38 | n.i. | n.i. | n.i. | n.i. | n.i. | n.i. |
| PtIP-65Fa | SEQ ID NO: 41 | n.i. | n.i. | n.i. | n.i. | n.i. | n.i. |
| PtIP-65Fb | SEQ ID NO: 42 | n.i. | n.i. | n.i. | n.i. | n.i. | n.i. |
| PtIP-65Ca | SEQ ID NO: 29 | 310-340 | n.i. | n.i. | n.i. | n.i. | n.i. |
| PtIP-65Aa | SEQ ID NO: 22 | 308-338 | n.i. | n.i. | n.i. | n.i. | n.i. |
| PtIP-65Ba | SEQ ID NO: 24 | 309-339 | n.i. | n.i. | n.i. | n.i. | n.i. |
| PtIP-65Bb | SEQ ID NO: 26 | 308-338 | n.i. | n.i. | n.i. | n.i. | n.i. |
| PtIP-65He | SEQ ID NO: 32 | n.i. | n.i. | n.i. | 263-298 | 300-349 | n.i. |
| PtIP-65Hf | SEQ ID NO: 33 | n.i. | n.i. | n.i. | 269-304 | | n.i. |
| PtIP-65Hb | SEQ ID NO: 31 | n.i. | n.i. | n.i. | 267-302 | 303-352 | n.i. |
| PtIP-65Hc | SEQ ID NO: 23 | n.i. | n.i. | n.i. | 270-305 | 306-355 | n.i. |
| PtIP-65Hd | SEQ ID NO: 28 | n.i. | n.i. | n.i. | 272-307 | 308-357 | n.i. |

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152).

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152); and at least one amino acid sequence motif selected from: i) an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); and ii) an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149).

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); and at least one amino acid sequence motif selected from: i) an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); ii) an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); iii) an amino acid sequence motif 12 as represented by an amino acid sequence of the formula [LM][AVY][QL][TV][PI][VG][YT][VL]IGGQGG[SN][AQS](SEQ ID NO: 158); and iv) an amino acid sequence motif 16 as represented by an amino acid sequence of the formula [AVS]SG[ILV][CW][VA]G[IVLF][TILMR] (SEQ ID NO: 162).

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 as represented by an amino acid sequence of the formula [LM][AVY][QL][TV][PI][VG][YT][VL]IGGQGG[SN][AQS] (SEQ ID NO: 158); an amino acid sequence motif 16 as represented by an amino acid sequence of the formula [AVS]SG[ILV][CW][VA]G[IVLF][TILMR] (SEQ ID NO: 162); and at least one amino acid sequence motif selected from: i) an amino acid sequence motif 11 as represented by an amino acid sequence of the formula K[ST]F[NT]L[QGL]N[TA]A[DHN][QH][DE]D[PQ]SST[EQ][QK]LAW[EQ]LADEP[SR]FDNV[SF][HL][ST]W[SI]LSN (SEQ ID NO: 157); ii) an amino acid sequence motif 17 as represented by an amino acid sequence of the formula D[GE][VA][QEA][KQR][TL]FGDP[SH][RD]P[APS]GE (SEQ ID NO: 163); iii) an amino acid sequence motif 20 as represented by an amino acid sequence of the formula DT[QE]SSSLSSSSSL[LS]LPWSR[NS]GSLLPS[EKQ]S[LF] (SEQ ID NO: 166); iv) an amino acid sequence motif 24 as represented by an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170); and v) an amino acid sequence motif 26 as represented by an amino acid sequence of the formula L[SV]AL[PT][YFR][RDGQ]G[NDIT][VAL][NSR][GDN]L[PFRS]F[NDET] (SEQ ID NO: 171).

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 as represented by an amino acid sequence of the formula [LM][AVY][QL][TV][PI][VG][YT][VL]IGGQGG[SN][AQS] (SEQ ID NO: 158); an amino acid sequence motif 16 as represented by an amino acid sequence of the formula [AVS]SG[ILV][CW][VA]G[IVLF][TILMR] (SEQ ID NO: 162); an amino acid sequence motif 11 as represented by an amino acid sequence of the formula K[ST]F[NT]L[QGL]N[TA]A[DHN][QH][DE]D[PQ]SST[EQ][QK]LAW[EQ]LADEP[SR]FDNV[SF][HL][ST]W[SI]LSN (SEQ ID NO: 157); an amino acid sequence motif 17 as represented by an amino acid sequence of the formula D[GE][VA][QEA][KQR][TL]FGDP[SH][RD]P[APS]GE (SEQ ID NO: 163); an amino acid sequence motif 20 as represented by an amino acid sequence of the formula DT[QE]SSSLSSSSSL[LS]LPWSR[NS]GSLLPS[EKQ]S[LF] (SEQ ID NO: 166); an amino acid sequence motif 24 as represented by an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170); and an amino acid sequence motif 26 as represented by an amino acid sequence of the formula L[SV]AL[PT][YFR][RDGQ]G[NDIT][VAL][NSR][GDN]L[PFRS]F[NDET] (SEQ ID NO: 171).

In some embodiments a PtIP-65 polypeptide comprises, sequentially from the N-terminus to the C-terminus of the PtIP-65 polypeptide, at least one amino acid sequence motif selected from: an amino acid sequence motif 12 as represented by an amino acid sequence of the formula [LM][AVY][QL][TV][PI][VG][YT][VL]IGGQGG[SN][AQS] (SEQ ID NO: 158); an amino acid sequence motif 2 as represented by an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 6 as represented by an amino acid sequence of the formula R[GL][SE]YSE[FY]TFA[DET]GERIT (SEQ ID NO: 152); an amino acid sequence motif 17 as represented by an amino acid sequence of the formula D[GE][VA][QEA][KQR][TL]FGDP[SH][RD]P[APS]GE (SEQ ID NO: 163); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 16 as represented by an amino acid sequence of the formula [AVS]SG[ILV][CW][VA]G[IVLF][TILMR] (SEQ ID NO: 162); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 11 as represented by an amino acid sequence of the formula K[ST]F[NT]L[QGL]N[TA]A[DHN][QH][DE]D[PQ]SST

[EQ][QK]LAW[EQ]LADEP[SR]FDNV[SF][HL][ST]W [SI]LSN (SEQ ID NO: 157); an amino acid sequence motif 5 as represented by an amino acid sequence of the formula [GQ][ILF][EIT][ATV][HT][AS]S[VI][TS]V[QES]A[GR] IP[AS][VL]AEV[SN]G[EV][FV]GW[SEQ][VI]S[VA][ST] (SEQ ID NO: 151); an amino acid sequence motif 20 as represented by an amino acid sequence of the formula DT[QE]SSSLSSSSSL[LS]LPWSR[NS]GSLLPS[EKQ]S [LF](SEQ ID NO: 166); an amino acid sequence motif 26 as represented by an amino acid sequence of the formula L[SV]AL[PT][YFR][RDGQ]G[NDIT][VAL][NSR][GDN] L[PFRS]F[NDET] (SEQ ID NO: 171) and an amino acid sequence motif 24 as represented by an amino acid sequence of the formula [AQ][RV][VT]TT[ST][GH][GS][TR]FSF [SP]GL[QHK]G[AFLR][FY]TG[QE]S[HY][VA][IP][AD] [IV]T[TAS]Q (SEQ ID NO: 170).

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152); an amino acid sequence motif 2 as represented by an amino acid sequence of the formula F[STR]Y[DY][GQ][GSE][TR][DN]G[RK]V[LM][QTR] [RK]I[GR]V[WY][AR][GA][ET][SW][RQ][IL][KR][AG]I [RES]VW[LM] (SEQ ID NO: 148); an amino acid sequence motif 3 as represented by an amino acid sequence of the formula GRA[NS][SV]D[IVL][DN][SA]LG[FV][VML] FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G [WAG]I[RY]F[YER]T[TNS][TQ][GN][GR][SRT]F[FD] [FPH][GK]M[TY]SWG[LK][KQ]TEYP[IVQ]DV (SEQ ID NO: 147); an amino acid sequence motif 5 as represented by an amino acid sequence of the formula [GQ][ILF][EIT] [ATV][HT][AS]S[VI][TS]V[QES]A[GR]IP[AS][VL]AEV [SN]G[EV][FV]GW[SEQ][VI]S[VA][ST] (SEQ ID NO: 151); an amino acid sequence motif 12 as represented by an amino acid sequence of the formula [LM][AVY][QL][TV] [PI][VG][YT][VL]IGGQGG[SN][AQS] (SEQ ID NO: 158); an amino acid sequence motif 16 as represented by an amino acid sequence of the formula [AVS]SG[ILV][CW] [VA]G[IVLF][TILMR] (SEQ ID NO: 162); and at least one amino acid sequence motif selected from: i) an amino acid sequence motif 8 as represented by an amino acid sequence of the formula [QG][EV][GK]D[HQ][NS]VQP[ND]KE[V-A][EKQ]E[CRS][KT][LV]LF[AIT]E (SEQ ID NO: 154); ii) an amino acid sequence motif 13 as represented by an amino acid sequence of the formula GVDYTSVDI[TV][NS][TQ] GTR[AD] (SEQ ID NO: 159); iii) an amino acid sequence motif 19 as represented by an amino acid sequence of the formula [TS]G[DSTN][DS][TSN]P[AHYRIAT][TVL][FY-C]G[TS][APV] (SEQ ID NO: 165); iv) an amino acid sequence motif 22 as represented by an amino acid sequence of the formula [KLS][DKN][EHQ]VEV[EQ]A[TV][DE] QQ (SEQ ID NO: 168); and v) an amino acid sequence motif 23 as represented by an amino acid sequence of the formula Y[TA][ST]TQEESRTLT (SEQ ID NO: 169).

In some embodiments a PtIP-65 polypeptide comprises an amino acid sequence motif 6 as represented by an amino acid sequence of the formula R[GL][SE]YSE[FY]TFA[DE-T]GERIT (SEQ ID NO: 152); an amino acid sequence motif 2 as represented by an amino acid sequence of the formula F[STR]Y[DY][GQ][GSE][TR][DN]G[RK]V[LM][QTR] [RK]I[GR]V[WY][AR][GA][ET][SW][RQ][IL][KR][AG]I [RES]VW[LM] (SEQ ID NO: 148); an amino acid sequence motif 3 as represented by an amino acid sequence of the formula GRA[NS][SV]D[IVL][DN][SA]LG[FV][VML] FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G [WAG]I[RY]F[YER]T[TNS][TQ][GN][GR][SRT]F[FD] [FPH][GK]M[TY]SWG[LK][KQ]TEYP[IVQ]DV (SEQ ID NO: 147); an amino acid sequence motif 5 as represented by an amino acid sequence of the formula [GQ][ILF][EIT] [ATV][HT][AS]S[VI][TS]V[QES]A[GR]IP[AS][VL]AEV [SN]G[EV][FV]GW[SEQ][VI]S[VA][ST] (SEQ ID NO: 151); an amino acid sequence motif 12 as represented by an amino acid sequence of the formula [LM][AVY][QL][TV] [PI][VG][YT][VL]IGGQGG[SN][AQS] (SEQ ID NO: 158); an amino acid sequence motif 16 as represented by an amino acid sequence of the formula [AVS]SG[ILV][CW] [VA]G[IVLF][TILMR] (SEQ ID NO: 162); an amino acid sequence motif 8 as represented by an amino acid sequence of the formula [QG][EV][GK]D[HQ][NS]VQP[ND]KE[V-A][EKQ]E[CRS][KT][LV]LF[AIT]E (SEQ ID NO: 154); an amino acid sequence motif 13 as represented by an amino acid sequence of the formula GVDYTSVDI[TV][NS][TQ] GTR[AD] (SEQ ID NO: 159); an amino acid sequence motif 19 as represented by an amino acid sequence of the formula [TS]G[DSTN][DS][TSN]P[AHYRIAT][TVL][FYC]G[TS] [APV] (SEQ ID NO: 165); an amino acid sequence motif 22 as represented by an amino acid sequence of the formula [KLS][DKN][EHQ]VEV[EQ]A[TV][DE]QQ (SEQ ID NO: 168); an amino acid sequence motif 23 as represented by an amino acid sequence of the formula Y[TA][ST]TQEES-RTLT (SEQ ID NO: 169); and at least one amino acid sequence motif selected from: i) an amino acid sequence motif 4 as represented by an amino acid sequence of the formula W[NG][QV]SGTL[ES][PA]G[QE][WS]I[SH][LI] [QK]A[TL]TR[RK]G[TL]I[TS][LV]P[YF]Q[GA][TS][MI] [EQ][IV]TL[QKL][SN]G[TD][VI]F[QR]Y[PA][IL][SK] [SG][MQ]Y (SEQ ID NO: 150); ii) an amino acid sequence motif 7 as represented by an amino acid sequence of the formula [NT]D[SK]NN[AD][GDS]S[IE][PS][KL]NW[TV] [FL][SA]GSR[TQ]VT[ITV]SS[ST]W[STR][LT]T (SEQ ID NO: 153); and iii) an amino acid sequence motif 15 as represented by an amino acid sequence of the formula [LF][ED][QT][AQ]G[IVST]P[VITQ][TA]L[DK] (SEQ ID NO: 161).

In some embodiments a PtIP-65 polypeptide comprises, sequentially from the N-terminus to the C-terminus of the PtIP-65 polypeptide, at least one amino acid sequence motif selected from: an amino acid sequence motif 12 as represented by an amino acid sequence of the formula [LM] [AVY][QL][TV][PI][VG][YT][VL]IGGQGG[SN][AQS] (SEQ ID NO: 158); an amino acid sequence motif 2 as represented by an amino acid sequence of the formula F[STR]Y[DY][GQ][GSE][TR][DN]G[RK]V[LM][QTR] [RK]I[GR]V[WY][AR][GA][ET][SW][RQ][IL][KR][AG]I [RES]VW[LM] (SEQ ID NO: 148); an amino acid sequence motif 19 as represented by an amino acid sequence of the formula [TS]G[DSTN][DS][TSN]P[AHYRIAT][TVL][FY-C]G[TS][APV] (SEQ ID NO: 165); an amino acid sequence motif 6 as represented by an amino acid sequence of the formula R[GL][SE]YSE[FY]TFA[DET]GERIT (SEQ ID NO: 152); an amino acid sequence motif selected from: an amino acid sequence motif 1 as represented by an amino acid sequence of the formula RLSLWGNGAGTR[SA]G [WAG]I[RY]F[YER]T[TNS][TQ][GN][GR][SRT]F[FD] [FPH][GK]M[TY]SWG[LK][KQ]TEYP[IVQ]DV (SEQ ID NO: 147); an amino acid sequence motif 16 as represented by an amino acid sequence of the formula [AVS]SG[ILV] [CW][VA]G[IVLF][TILMR] (SEQ ID NO: 162); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 15 as represented by an amino acid sequence of the formula [LF][ED][QT][AQ]GI[IVST]P[VITQ][TA]L[DK] (SEQ ID NO: 161); an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 23 as represented by an amino acid sequence of the formula Y[TA][ST]TQEESRTLT (SEQ ID NO: 169); an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); an amino acid sequence motif 13 as represented by an amino acid sequence of the formula GVDYTSVDI[TV][NS][TQ]GTR[AD] (SEQ ID NO: 159); an amino acid sequence motif 22 as represented by an amino acid sequence of the formula [KLS][DKN][EHQ]VEV[EQ]A[TV][DE]QQ (SEQ ID NO: 168); and an amino acid sequence motif 8 as represented by an amino acid sequence of the formula [QG][EV][GK]D[HQ][NS]VQP[ND]KE[VA][EKQ]E[CRS][KT][LV]LF[AIT]E (SEQ ID NO: 154).

In some embodiments a PtIP-65 polypeptide comprises, sequentially from the N-terminus to the C-terminus of the PtIP-65 polypeptide, at least one amino acid sequence motif selected from: an amino acid sequence motif 2 as represented by an amino acid sequence of the formula F[STR]Y[DY][GQ][GSE][TR][DN]G[RK][V[LM][QTR][RK]I[GR]V[WY][AR][GA][ET][SW][RQ][IL][KR][AG]I[RES]VW[LM] (SEQ ID NO: 148); an amino acid sequence motif 19 as represented by an amino acid sequence of the formula [TS]G[DSTN][DS][TSN]P[AHYRIAT][TVL][FYC]G[TS][APV] (SEQ ID NO: 165); an amino acid sequence motif 6 as represented by an amino acid sequence of the formula R[GL][SE]YSE[FY]TFA[DET]GERIT (SEQ ID NO: 152); an amino acid sequence motif 10 as represented by an amino acid sequence of the formula [WPY][DTN][HNV][VI][AG]R[VI][RW]F[SQ]TS[RL][GL]R[TI]FE[YF]G[SM][ST][RV][EQ]P[ST]G[QKR][WV][FIT][TE][VA]NVGS-GVCVG[VM] (SEQ ID NO: 156); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 27 as represented by an amino acid sequence of the formula T[TFPS]IL[EQS][EQH]LP[DA] (SEQ ID NO: 172); an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 21 as represented by an amino acid sequence of the formula HL[TV][GA][NRS][AND]I[STL][IVL][ND][VILM][DTS]LGI[ND][TA]P[TK][VI]V[PA] (SEQ ID NO: 167); an amino acid sequence motif 18 as represented by an amino acid sequence of the formula G[TLP][AE]GAST[NTA]F[GQH]W[EQ]T[VA]R[TA]FPS[TIS]NA (SEQ ID NO: 164); an amino acid sequence motif 9 as represented by an amino acid sequence of the formula [IMV][QE]G[ST]I[AS][ND]L[TI]V[SRT]T[NAD][EA]YSVW[CG]H[IV]SDT[LVI]APAQ[SL][LI][PI][K S][HR][RASV]A (SEQ ID NO: 155); an amino acid sequence motif 14 as represented by an amino acid sequence of the formula [LW][VI]GEG[RS]I[TD][AN][LPQ]CSA[NR]IQV[FIL]T[SD][GAS][GAD][NGY][NDG][LF]PF[AG][TS]F[ST]FPV[RGQ][LSV][LF]Y[DNS][GA][GR]AHS[DNQT]VQ[VI][LI] (SEQ ID NO: 160).

In some embodiments a PtIP-65 polypeptide comprises an amino acid sequence motif 6 as represented by an amino acid sequence of the formula R[GL][SE]YSE[FY]TFA[DET]GERIT (SEQ ID NO: 152); an amino acid sequence motif 2 as represented by an amino acid sequence of the formula F[STR]Y[DY][GQ][GSE][TR][DN]G[RK][V[LM][QTR][RK]I[GR]V[WY][AR][GA][ET][SW][RQ][IL][KR][AG]I[RES]VW[LM] (SEQ ID NO: 148); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI ]S[VA][ST] (SEQ ID NO: 151); an amino acid sequence motif 12 as represented by an amino acid sequence of the formula [LM][AVY][QL][TV][PI][VG][YT][VL]IGGQGG[SN][AQS] (SEQ ID NO: 158); an amino acid sequence motif 16 as represented by an amino acid sequence of the formula [AVS]SG[ILV][CW][VA]G[IVLF][TILMR] (SEQ ID NO: 162); and at least one amino acid sequence motif selected from: i) an amino acid sequence motif 17 as represented by an amino acid sequence of the formula D[GE][VA][QEA][KQR][TL]FGDP[SH][RD]P[APS]GE (SEQ ID NO: 163); ii) an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); iii) an amino acid sequence motif 7 as represented by an amino acid sequence of the formula [NT]D[SK]NN[AD][GDS]S[IE][PS][KL]N-W[TV][FL][SA]GSR[TQ]VT[ITV]SS[ST]W[STR][LT]T (SEQ ID NO: 153); and iv) an amino acid sequence motif 15 as represented by an amino acid sequence of the formula [LF][ED][QT][AQ]GI[IVST]P[VITQ][TA]L[DK] (SEQ ID NO: 161).

In some embodiments a PtIP-65 polypeptide comprises, sequentially from the N-terminus to the C-terminus of the PtIP-65 polypeptide, at least one amino acid sequence motif selected from: an amino acid sequence motif 12 as represented by an amino acid sequence of the formula [LM][AVY][QL][TV][PI][VG][YT][VL]IGGQGG[SN][AQS] (SEQ ID NO: 158); an amino acid sequence motif 2 as represented by an amino acid sequence of the formula F[STR]Y[DY][GQ][GSE][TR][DN]G[RK][V[LM][QTR][RK]I[GR]V[WY][AR][GA][ET][SW][RQ][IL][KR][AG]I[RES]VW[LM] (SEQ ID NO: 148); an amino acid sequence motif 6 as represented by an amino acid sequence of the formula R[GL][SE]YSE[FY]TFA[DET]GERIT (SEQ ID NO: 152); an amino acid sequence motif 17 as represented by an amino acid sequence of the formula D[GE][VA][QEA][KQR][TL]FGDP[SH][RD]P[APS]GE (SEQ ID NO: 163); an amino acid sequence motif selected from: an amino acid sequence motif 1 as represented by an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 16 as represented by an amino acid sequence of the formula [AVS]SG[ILV][CW][VA]G[IVLF][TILMR] (SEQ ID NO: 162); an amino acid sequence motif 3 as represented by an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 15 as represented by an amino acid sequence of the formula [LF][ED][QT][AQ]GI[IVST]P[VITQ][TA]L[DK] (SEQ ID NO: 161); an amino acid sequence motif 7 as represented by an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 5 as represented by an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); and an amino acid sequence motif 4 as represented by an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK]SG[MQ]Y (SEQ ID NO: 150).

In some embodiments a PtIP-65 polypeptide comprises an amino acid sequence motif 6 having at least 90% identity to an amino acid sequence of the formula R[GL][SE]YSE[FY]TFA[DET]GERIT (SEQ ID NO: 152).

In some embodiments a PtIP-65 polypeptide comprises an amino acid sequence motif 6 having at least 90% identity to an amino acid sequence of the formula R[GL][SE]YSE[FY]TFA[DET]GERIT (SEQ ID NO: 152); and at least one amino acid sequence motif selected from: i) an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); and ii) an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149).

In some embodiments a PtIP-65 polypeptide comprises an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); and at least one amino acid sequence motif selected from: i) an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); ii) an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); iii) an amino acid sequence motif 12 having at least 90% identity to an amino acid sequence of the formula [LM][AVY][QL][TV][P][TV][P][VG][YT][VL]IGGQGG[SN][AQS] (SEQ ID NO: 158); and iv) an amino acid sequence motif 16 having at least 90% identity to an amino acid sequence of the formula [AVS]SG[ILV][CW][VA]G[IVLF][TILMR] (SEQ ID NO: 162).

In some embodiments a PtIP-65 polypeptide comprises an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); and at least one amino acid sequence motif selected from: i) an amino acid sequence motif 11 having at least 90% identity to an amino acid sequence of the formula K[ST]F[NT]L[QGL]N[TA]A[DHN][QH][DE]D[PQ]SST[EQ][QK]LAW[EQ]LADEP[SR]FDNV[SF][HL][ST]W[SI]LSN (SEQ ID NO: 157); ii) an amino acid sequence motif 17 having at least 90% identity to an amino acid sequence of the formula D[GE][VA][QEA][KQR][TL]FGDP[SH][RD]P[APS]GE (SEQ ID NO: 163); iii) an amino acid sequence motif 20 having at least 90% identity to an amino acid sequence of the formula DT[QE]SSSLSSSSSL[LS]LPWSR[NS]GSLLPS[EKQ]S[LF] (SEQ ID NO: 166); iv) an amino acid sequence motif 24 having at least 90% identity to an amino acid sequence of the formula [AQ][RV][VT]TT[ST][GH][GS][TR]FSF[SP]GL[QHK]G[AFLR][FY]TG[QE]S[HY][VA][IP][AD][IV]T[TAS]Q (SEQ ID NO: 170); and v) an amino acid sequence motif 26 having at least 90% identity to an amino acid sequence of the formula L[SV]AL[PT][YFR][RDGQ]G[NDIT][VAL][NSR][GDN]L[PFRS]F[NDET] (SEQ ID NO: 171).

In some embodiments a PtIP-65 polypeptide comprises an amino acid sequence motif 6 having at least 90% identity to an amino acid sequence of the formula R[GL][SE]YSE[FY]TFA[DET]GERIT (SEQ ID NO: 152); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR [SA]G[WAG]I[RY]F[YER]T[TNS][TQ][GN][GR][SRT]F [FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES] A[GR]IP[AS][VL]AEV[SN]G[EV][FV]GW[SEQ][VI]S [VA][ST] (SEQ ID NO: 151); an amino acid sequence motif 12 having at least 90% identity to an amino acid sequence of the formula [LM][AVY][QL][TV][P][TV][P][VG][YT] [VL]IGGQGG[SN][AQS] (SEQ ID NO: 158); an amino acid sequence motif 16 having at least 90% identity to an amino acid sequence of the formula [AVS]SG[ILV][CW] [VA]G[IVLF][TILMR] (SEQ ID NO: 162); an amino acid sequence motif 11 having at least 90% identity to an amino acid sequence of the formula K[ST]F[NT]L[QGL]N[TA]A [DHN][QH][DE]D[PQ]SST[EQ][QK]LAW[EQ]LADEP [SR]FDNV[SF][HL][ST]W[SI]LSN (SEQ ID NO: 157); an amino acid sequence motif 17 having at least 90% identity to an amino acid sequence of the formula D[GE][VA][QEA] [KQR][TL]FGDP[SH][RD]P[APS]GE (SEQ ID NO: 163); an amino acid sequence motif 20 having at least 90% identity to an amino acid sequence of the formula DT[QE] SSSLSSSSSL[LS]LPWSR[NS]GSLLPS[EKQ]S[LF] (SEQ ID NO: 166); an amino acid sequence motif 24 having at least 90% identity to an amino acid sequence of the formula [AQ][RV][VT]TT[ST][GH][GS][TR]FSF[SP]GL[QHK]G [AFLR][FY]TG[QE]S[HY][VA][IP][AD][IV]T[TAS]Q (SEQ ID NO: 170); and an amino acid sequence motif 26 having at least 90% identity to an amino acid sequence of the formula L[SV]AL[PT][YFR][RDGQ]G[NDIT][VAL] [NSR][GDN]L[PFRS]F[NDET] (SEQ ID NO: 171).

In some embodiments a PtIP-65 polypeptide comprises, sequentially from the N-terminus to the C-terminus of the PtIP-65 polypeptide, an amino acid sequence motif 12 having at least 90% identity to an amino acid sequence of the formula [LM][AVY][QL][TV][PI][VG][YT][VL]IGGQGG [SN][AQS] (SEQ ID NO: 158); an amino acid sequence motif 2 having at least 90% identity to an amino acid sequence of the formula F[STR]Y[DY][GQ][GSE][TR] [DN]G[RK]V[LM][QTR][RK]I[GR]V[WY][AR][GA][ET] [SW][RQ][IL][KR][AG]I[RES]VW[LM] (SEQ ID NO: 148); an amino acid sequence motif 6 having at least 90% identity to an amino acid sequence of the formula R[GL] [SE]YSE[FY]TFA[DET]GERIT (SEQ ID NO: 152); an amino acid sequence motif 17 having at least 90% identity to an amino acid sequence of the formula D[GE][VA][QEA] [KQR][TL]FGDP[SH][RD]P[APS]GE (SEQ ID NO: 163); an amino acid sequence motif selected from: an amino acid sequence motif 1 having at least 90% identity to an amino acid sequence of the formula RLSLWGNGAGTR[SA]G [WAG]I[RY]F[YER]T[TNS][TQ][GN][GR][SRT]F[FD] [FPH][GK]M[TY]SWG[LK][KQ]TEYP[IVQ]DV (SEQ ID NO: 147); an amino acid sequence motif 16 having at least 90% identity to an amino acid sequence of the formula [AVS]SG[ILV][CW][VA]G[IVLF][TILMR] (SEQ ID NO: 162); an amino acid sequence motif 3 having at least 90% identity to an amino acid sequence of the formula GRA[NS] [SV]D[IVL][DN][SA]LG[FV][VML]FLR[PTS]I[QA]S [AVCS]R[LM]I[NS]V[QS]YPTL (SEQ ID NO: 149); an amino acid sequence motif 11 having at least 90% identity to an amino acid sequence of the formula K[ST]F[NT]L [QGL]N[TA]A[DHN][QH][DE]D[PQ]SST[EQ][QK]LAW [EQ]LADEP[SR]FDNV[SF][HL][ST]W[SI]LSN (SEQ ID NO: 157); an amino acid sequence motif 5 having at least 90% identity to an amino acid sequence of the formula [GQ][ILF][EIT][ATV][HT][AS]S[VI][TS]V[QES]A[GR] IP[AS][VL]AEV[SN]G[EV][FV]GW[SEQ][VI]S[VA][ST] (SEQ ID NO: 151); an amino acid sequence motif 20 having at least 90% identity to an amino acid sequence of the formula DT[QE]SSSLSSSSSL[LS]LPWSR[NS]GSLLPS [EKQ]S[LF] (SEQ ID NO: 166); an amino acid sequence motif 26 having at least 90% identity to an amino acid sequence of the formula L[SV]AL[PT][YFR][RDGQ]G[N-DIT][VAL][NSR][GDN]L[PFRS]F[NDET] (SEQ ID NO: 171) and an amino acid sequence motif 24 having at least 90% identity to an amino acid sequence of the formula [AQ][RV][VT]TT[ST][GH][GS][TR]FSF[SP]GL[QHK]G [AFLR][FY]TG[QE]S[HY][VA][IP][AD][IV]T[TAS]Q (SEQ ID NO: 170).

In some embodiments a PtIP-65 polypeptide comprises an amino acid sequence motif 6 having at least 90% identity to an amino acid sequence of the formula R[GL][SE]YSE[FY] TFA[DET]GERIT (SEQ ID NO: 152); an amino acid sequence motif 2 having at least 90% identity to an amino acid sequence of the formula F[STR]Y[DY][GQ][GSE] [TR][DN]G[RK]V[LM][QTR][RK]I[GR]V[WY][AR] [GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I [QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR [SA]G[WAG]I[RY]F[YER]T[TNS][TQ][GN][GR][SRT]F [FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES] A[GR]IP[AS][VL]AEV[SN]G[EV][FV]GW[SEQ][VI]S [VA][ST] (SEQ ID NO: 151); an amino acid sequence motif 12 having at least 90% identity to an amino acid sequence of the formula [LM][AVY][QL][TV][PI][VG][YT][VL]IG-GQGG[SN][AQS] (SEQ ID NO: 158); an amino acid sequence motif 16 having at least 90% identity to an amino acid sequence of the formula [AVS]SG[ILV][CW][VA]G [IVLF][TILMR] (SEQ ID NO: 162); and at least one amino acid sequence motif selected from: i) an amino acid sequence motif 8 having at least 90% identity to an amino acid sequence of the formula [QG][EV][GK]D[HQ][NS] VQP[ND]KE[VA][EKQ]E[CRS][KT][LV]LF[AIT]E (SEQ ID NO: 154); ii) an amino acid sequence motif 13 having at least 90% identity to an amino acid sequence of the formula GVDYTSVDI[TV][NS][TQ]GTR[AD] (SEQ ID NO: 159); iii) an amino acid sequence motif 19 having at least 90% identity to an amino acid sequence of the formula [TS]G [DSTN][DS][TSN]P[AHYRIAT][TVL][FYC]G[TS][APV] (SEQ ID NO: 165); iv) an amino acid sequence motif 22 having at least 90% identity to an amino acid sequence of the formula [KLS][DKN][EHQ]VEV[EQ]A[TV][DE]QQ (SEQ ID NO: 168); and v) an amino acid sequence motif 23 having at least 90% identity to an amino acid sequence of the formula Y[TA][ST]TQEESRTLT (SEQ ID NO: 169).

In some embodiments a PtIP-65 polypeptide comprises an amino acid sequence motif 6 having at least 90% identity to an amino acid sequence of the formula R[GL][SE]YSE[FY] TFA[DET]GERIT (SEQ ID NO: 152); an amino acid sequence motif 2 having at least 90% identity to an amino acid sequence of the formula F[STR]Y[DY][GQ][GSE] [TR][DN]G[RK]V[LM][QTR][RK]I[GR]V[WY][AR] [GA][ET][SW][RQ][IL][KR][AG]I[RES]VW[LM] (SEQ ID NO: 148); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 12 having at least 90% identity to an amino acid sequence of the formula [LM][AVY][QL][TV][P][TV][P][VG][YT][VL]IGGQGG[SN][AQS] (SEQ ID NO: 158); an amino acid sequence motif 16 having at least 90% identity to an amino acid sequence of the formula [AVS]SG[ILV][CW][VA]G[IVLF][TILMR] (SEQ ID NO: 162); an amino acid sequence motif 8 having at least 90% identity to an amino acid sequence of the formula [QG][EV][GK]D[HQ][NS]VQP[ND]KE[VA][EKQ]E[CRS][KT][LV]LF[AIT]E (SEQ ID NO: 154); an amino acid sequence motif 13 having at least 90% identity to an amino acid sequence of the formula GVDYTSVDI[TV][NS][TQ]GTR[AD] (SEQ ID NO: 159); an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); an amino acid sequence motif 22 having at least 90% identity to an amino acid sequence of the formula [KLS][DKN][EHQ]VEV[EQ]A[TV][DE]QQ (SEQ ID NO: 168); an amino acid sequence motif 23 having at least 90% identity to an amino acid sequence of the formula Y[TA][ST]TQEESRTLT (SEQ ID NO: 169); and at least one amino acid sequence motif selected from: i) an amino acid sequence motif 4 having at least 90% identity to an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); ii) an amino acid sequence motif 7 having at least 90% identity to an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); and iii) an amino acid sequence motif 15 having at least 90% identity to an amino acid sequence of the formula [LF][ED][QT][AQ]GI[IVST]P[VITQ][TA]L[DK] (SEQ ID NO: 161).

In some embodiments a PtIP-65 polypeptide comprises, sequentially from the N-terminus to the C-terminus of the PtIP-65 polypeptide, an amino acid sequence motif 12 having at least 90% identity to an amino acid sequence of the formula [LM][AVY][QL][TV][PI][VG][YT][VL]IGGQGG[SN][AQS] (SEQ ID NO: 158); an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); an amino acid sequence motif 6 having at least 90% identity to an amino acid sequence of the formula R[GL][SE]YSE[FY]TFA[DET]GERIT (SEQ ID NO: 152); an amino acid sequence motif selected from: an amino acid sequence motif 1 having at least 90% identity to an amino acid sequence of the formula RLSLWGNGAGTR[SA]G[WAG]I[RY]F[YER]T[TNS][TQ][GN][GR][SRT]F[FD][FPH][GK]M[TY]SWG[LK][KQ]TEYP[IVQ]DV (SEQ ID NO: 147); an amino acid sequence motif 16 having at least 90% identity to an amino acid sequence of the formula [AVS]SG[ILV][CW][VA]G[IVLF][TILMR] (SEQ ID NO: 162); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 15 having at least 90% identity to an amino acid sequence of the formula [LF][ED][QT][AQ]GI[IVST]P[VITQ][TA]L[DK] (SEQ ID NO: 161); an amino acid sequence motif 7 having at least 90% identity to an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 5 having at least 90% identity to an amino acid sequence of the formula [GQ][ILF][EIT][ATV][HT][AS]S[VI][TS]V[QES]A[GR]IP[AS][VL]AEV[SN]G[EV][FV]GW[SEQ][VI]S[VA][ST] (SEQ ID NO: 151); an amino acid sequence motif 23 having at least 90% identity to an amino acid sequence of the formula Y[TA][ST]TQEESRTLT (SEQ ID NO: 169); an amino acid sequence motif 4 having at least 90% identity to an amino acid sequence of the formula W[NG][QV]SGTL[ES][PA]G[QE][WS]I[SH][LI][QK]A[TL]TR[RK]G[TL]I[TS][LV]P[YF]Q[GA][TS][MI][EQ][IV]TL[QKL][SN]G[TD][VI]F[QR]Y[PA][IL][SK][SG][MQ]Y (SEQ ID NO: 150); an amino acid sequence motif 13 having at least 90% identity to an amino acid sequence of the formula GVDYTSVDI[TV][NS][TQ]GTR[AD] (SEQ ID NO: 159); an amino acid sequence motif 22 having at least 90% identity to an amino acid sequence of the formula [KLS][DKN][EHQ]VEV[EQ]A[TV][DE]QQ (SEQ ID NO: 168); and an amino acid sequence motif 8 having at least 90% identity to an amino acid sequence of the formula [QG][EV][GK]D[HQ][NS]VQP[ND]KE[VA][EKQ]E[CRS][KT][LV]LF[AIT]E (SEQ ID NO: 154).

In some embodiments a PtIP-65 polypeptide comprises, sequentially from the N-terminus to the C-terminus of the PtIP-65 polypeptide, an amino acid sequence motif 2 having at least 90% identity to an amino acid sequence of the formula F[STR]Y[DY][GQ][GSE][TR][DN]G[RK]V[LM][QTR][RK]I[GR]V[WY][AR][GA][ET][SW][RQ][IL][KR][AG]I[RES]VW[LM] (SEQ ID NO: 148); an amino acid sequence motif 19 having at least 90% identity to an amino acid sequence of the formula [TS]G[DSTN][DS][TSN]P[AHYRIAT][TVL][FYC]G[TS][APV] (SEQ ID NO: 165); an amino acid sequence motif 6 having at least 90% identity to an amino acid sequence of the formula R[GL][SE]YSE[FY]TFA[DET]GERIT (SEQ ID NO: 152); an amino acid sequence motif 10 having at least 90% identity to an amino acid sequence of the formula [WPY][DTN][HNV][VI][AG]R[VI][RW]F[SQ]TS[RL][GL]R[TI]FE[YF]G[SM][ST][RV][EQ]P[ST]G[QKR][WV][FIT][TE][VA]NVGSGVCVG[VM] (SEQ ID NO: 156); an amino acid sequence motif 3 having at least 90% identity to an amino acid sequence of the formula GRA[NS][SV]D[IVL][DN][SA]LG[FV][VML]FLR[PTS]I[QA]S[AVCS]R[LM]I[NS]V[QS]YPTL (SEQ ID NO: 149); an amino acid sequence motif 27 having at least 90% identity to an amino acid sequence of the formula T[TFPS]IL[EQS][EQH]LP[DA] (SEQ ID NO: 172); an amino acid sequence motif 7 having at least 90% identity to an amino acid sequence of the formula [NT]D[SK]NN[AD][GDS]S[IE][PS][KL]NW[TV][FL][SA]GSR[TQ]VT[ITV]SS[ST]W[STR][LT]T (SEQ ID NO: 153); an amino acid sequence motif 21 having at least 90% identity to an amino acid sequence of the formula HL[TV][GA][NRS][AND]I[STL][IVL][ND][VILM][DTS]
LGI[ND][TA]P[TK][VI]V[PA] (SEQ ID NO: 167); an
amino acid sequence motif 18 having at least 90% identity
to an amino acid sequence of the formula G[TLP][AE]
GAST[NTA]F[GQH]W[EQ]T[VA]R[TA]FPS[TIS]NA
(SEQ ID NO: 164); an amino acid sequence motif 9 having
at least 90% identity to an amino acid sequence of the
formula [IMV][QE]G[ST]I[AS][ND]L[TI]V[SRT]T[NAD]
[EA]YSVW[CG]H[IV]SDT[LVI]APAQ[SL][LI][PI][K
S][HR][RASV]A (SEQ ID NO: 155); an amino acid
sequence motif 14 having at least 90% identity to an amino
acid sequence of the formula [LW][VI]GEG[RS]I[TD][AN]
L[PQ]CSA[NR]IQV[FIL]T[SD][GAS][GAD][NGY]
[NDG][LF]PF[AG][TS]F[ST]FPV[RGQ][LSV][LF]Y
[DNS][GA][GR]AHS[DNQT]VQ[VI][LI] (SEQ ID NO:
160).

In some embodiments a PtIP-65 polypeptide comprises an
amino acid sequence motif 6 having at least 90% identity to
an amino acid sequence of the formula R[GL][SE]YSE[FY]
TFA[DET]GERIT (SEQ ID NO: 152); an amino acid
sequence motif 2 having at least 90% identity to an amino
acid sequence of the formula F[STR]Y[DY][GQ][GSE]
[TR][DN]G[RK]V[LM][QTR][RK]I[GR]V[WY][AR]
[GA][ET][SW][RQ][IL][KR][AG]I[RES]VW[LM] (SEQ
ID NO: 148); an amino acid sequence motif 3 having at least
90% identity to an amino acid sequence of GRA[NS][SV]
D[IVL][DN][SA]LG[FV][VML]FLR[PTS]I[QA]S[AVCS]
R[LM]I[NS]V[QS]YPTL (SEQ ID NO: 149); an amino acid
sequence motif selected from: an amino acid sequence motif
1 having at least 90% identity to an amino acid sequence of
the formula RLSLWGNGAGTR[SA]G[WAG]I[RY]F
[YER]T[TNS][TQ][GN][GR][SRT]F[FD][FPH][GK]M
[TY]SWG[LK][KQ]TEYP[IVQ]DV (SEQ ID NO: 147); an
amino acid sequence motif 5 having at least 90% identity to
an amino acid sequence of the formula [GQ][ILF][EIT]
[ATV][HT][AS]S[VI][TS]V[QES]A[GR]IP[AS][VL]AEV
[SN]G[EV][FV]GW[SEQ][VI]S[VA][ST] (SEQ ID NO:
151); an amino acid sequence motif 12 having at least 90%
identity to an amino acid sequence of the formula [LM]
[AVY][QL][TV][P][TV][P][VG][YT][VL]IGGQGG[SN]
[AQS] (SEQ ID NO: 158); an amino acid sequence motif 16
having at least 90% identity to an amino acid sequence of the
formula [AVS]SG[ILV][CW][VA]G[IVLF][TILMR] (SEQ
ID NO: 162); and at least one amino acid sequence motif
selected from: i) an amino acid sequence motif 17 having at
least 90% identity to an amino acid sequence of the formula
D[GE][VA][QEA][KQR][TL]FGDP[SH][RD]P[APS]GE
(SEQ ID NO: 163); ii) an amino acid sequence motif 4
having at least 90% identity to an amino acid sequence of the
formula W[NG][QV]SGTL[ES][PA]G[QE][WS]I[SH][LI]
[QK]A[TL]TR[RK]G[TL]I[TS][LV]P[YF]Q[GA][TS][MI]
[EQ][IV]TL[QKL][SN]G[TD][VI]F[QR]Y[PA][IL][SK]
[SG][MQ]Y (SEQ ID NO: 150); iii) an amino acid sequence
motif 7 having at least 90% identity to an amino acid
sequence of the formula [NT]D[SK]NN[AD][GDS]S[IE]
[PS][KL]NW[TV][FL][SA]GSR[TQ]VT[ITV]SS[ST]W
[STR][LT]T (SEQ ID NO: 153); and iv) an amino acid
sequence motif 15 having at least 90% identity to an amino
acid sequence of the formula [LF][ED][QT][AQ]GI[IVST]
P[VITQ][TA]L[DK] (SEQ ID NO: 161).

In some embodiments a PtIP-65 polypeptide comprises,
sequentially from the N-terminus to the C-terminus of the
PtIP-65 polypeptide, an amino acid sequence motif 12
having at least 90% identity to an amino acid sequence of the
formula [LM][AVY][QL][TV][PI][VG][YT][VL]IGGQGG
[SN][AQS] (SEQ ID NO: 158); an amino acid sequence
motif 2 having at least 90% identity to an amino acid sequence of the formula F[STR]Y[DY][GQ][GSE][TR]
[DN]G[RK]V[LM][QTR][RK]I[GR]V[WY][AR][GA][ET]
[SW][RQ][IL][KR][AG]I[RES]VW[LM] (SEQ ID NO:
148); an amino acid sequence motif 6 having at least 90%
identity to an amino acid sequence of the formula R[GL]
[SE]YSE[FY]TFA[DET]GERIT (SEQ ID NO: 152); an
amino acid sequence motif 17 having at least 90% identity
to an amino acid sequence of the formula D[GE][VA][QEA]
[KQR][TL]FGDP[SH][RD]P[APS]GE (SEQ ID NO: 163);
an amino acid sequence motif selected from: an amino acid
sequence motif 1 having at least 90% identity to an amino
acid sequence of the formula RLSLWGNGAGTR[SA]G
[WAG]I[RY]F[YER]T[TNS][TQ][GN][GR][SRT]F[FD]
[FPH][GK]M[TY]SWG[LK][KQ]TEYP[IVQ]DV (SEQ ID
NO: 147); an amino acid sequence motif 16 having at least
90% identity to an amino acid sequence of the formula
[AVS]SG[ILV][CW][VA]G[IVLF][TILMR] (SEQ ID NO:
162); an amino acid sequence motif 3 having at least 90%
identity to an amino acid sequence of the formula GRA[NS]
[SV]D[IVL][DN][SA]LG[FV][VML]FLR[PTS]I[QA]S
[AVCS]R[LM]I[NS]V[QS]YPTL (SEQ ID NO: 149); an
amino acid sequence motif 15 having at least 90% identity
to an amino acid sequence of the formula [LF][ED][QT]
[AQ]GI[IVST]P[VITQ][TA]L[DK] (SEQ ID NO: 161); an
amino acid sequence motif 7 having at least 90% identity to
an amino acid sequence of the formula [NT]D[SK]NN[AD]
[GDS]S[IE][PS][KL]NW[TV][FL][SA]GSR[TQ]VT[ITV]
SS[ST]W[STR][LT]T (SEQ ID NO: 153); an amino acid
sequence motif 5 having at least 90% identity to an amino
acid sequence of the formula [GQ][ILF][EIT][ATV][HT]
[AS]S[VI][TS]V[QES]A[GR]IP[AS][VL]AEV[SN]G[EV]
[FV]GW[SEQ][VI]S[VA][ST] (SEQ ID NO: 151); and an
amino acid sequence motif 4 having at least 90% identity to
an amino acid sequence of the formula W[NG][QV]SGTL
[ES][PA]G[QE][WS]I[SH][LI][QK]A[TL]TR[RK]G[TL]I
[TS][LV]P[YF]Q[GA][TS][MI][EQ][IV]TL[QKL][SN]G
[TD][VI]F[QR]Y[PA][IL][SK][SG][MQ]Y (SEQ ID NO:
150).

In some embodiments a PtIP-65 polypeptide comprises an
amino acid sequence motif 6 as represented by an amino
acid sequence of the formula R[GLIV][SETD]YSE[FYW]
TFA[DETS]GERIT (SEQ ID NO: 178).

In some embodiments a PtIP-65 polypeptide comprises an
amino acid sequence motif 6 as represented by an amino
acid sequence of the formula R[GLIV][SETD]YSE[FYW]
TFA[DETS]GERIT (SEQ ID NO: 178); and at least one
amino acid sequence motif selected from: i) an amino acid
sequence motif 2 as represented by an amino acid sequence
of the formula F[STRK]Y[DYEWF][GQN][GSETD]
[TRKS][DNQE]G[RK]V[LMIV][QTRNSK][RK]I[GRK]V
[WY][ARK][GA][ETDS][SWTYF][RQKN][ILV][KR]
[AG]I[RESKDT]VW[LMIV] (SEQ ID NO: 174); and ii) an
amino acid sequence motif 3 as represented by an amino
acid sequence of the formula GRA[NSQT][SVTIL]D[IVL]
[DNQE][SAT]LG[FVIL][VMLI]FLR[PTS]I[QAN]S[AVC-
SILT]R[LMIV]I [NSQT]V[QSNT]YPTL (SEQ ID NO:
175).

In some embodiments a PtIP-65 polypeptide comprises an
amino acid sequence motif 6 as represented by an amino
acid sequence of the formula R[GLIV][SETD]YSE[FYW]
TFA[DETS]GERIT (SEQ ID NO: 178); an amino acid
sequence motif 2 as represented by an amino acid sequence
of the formula F[STRK]Y[DYEWF][GQN][GSETD]
[TRKS][DNQE]G[RK]V[LMIV][QTRNSK][RK]I[GRK]V
[WY][ARK][GA][ETDS][SWTYF][RQKN][ILV][KR]
[AG]I[RESKDT]VW[LMIV] (SEQ ID NO: 174); an amino
acid sequence motif 3 as represented by an amino acid sequence of the formula GRA[NSQT][SVTIL]D[IVL][DN-QE][SAT]LG[FVIL][VMLI]FLR[PTS]I[QAN]S[AVC-SILT]R[LMIV]I [NSQT]V[QSNT]YPTL (SEQ ID NO: 175); and at least one amino acid sequence motif selected from: i) an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); ii) an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); iii) an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); and iv) an amino acid sequence motif 16 as represented by an amino acid sequence of the formula [AVSILT]SG[ILV][CWY][VAIL]G[IVLF][TILMRSVK] (SEQ ID NO: 188).

In some embodiments a PtIP-65 polypeptide comprises an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 as represented by an amino acid sequence of the formula GRA[NSQT][SVTIL]D[IVL][DN-QE][SAT]LG[FVIL][VMLI]FLR[PTS]I[QAN]S[AVC-SILT]R[LMIV]I [NSQT]V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 as represented by an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 11 as represented by an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); ii) an amino acid sequence motif 17 as represented by an amino acid sequence of the formula D[GED][VAIL][QEAND][KQRN][TLSIV]FGDP[SHT][RDKE]P[APST]GE (SEQ ID NO: 189); iii) an amino acid sequence motif 20 as represented by an amino acid sequence of the formula DT[QEND]SSSLSSSSSL[LSIVT]LPWSR[NSQT]GSLLPS[EKQDNR]S[LFIV] (SEQ ID NO: 192); iv) an amino acid sequence motif 24 as represented by an amino acid sequence of the formula [AQN][RVKIL][VTIL-S]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196); and v) an amino acid sequence motif 26 as represented by an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197).

In some embodiments a PtIP-65 polypeptide comprises an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 as represented by an amino acid sequence of the formula GRA[NSQT][SVTIL]D[IVL][DN-QE][SAT]LG[FVIL][VMLI]FLR[PTS]I[QAN]S[AVC-SILT]R[LMIV]I [NSQT]V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 as represented by an amino acid sequence of the formula [GQN][ILFV][EIT-DLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TV-SIL][PILV][VGIL][YTWS][VLI]IGGQGG[SNTQ][AQSNT] (SEQ ID NO: 184); an amino acid sequence motif 16 as represented by an amino acid sequence of the formula [AVSILT]SG[ILV][CWY][VAIL]G[IVLF][TILMRSVK] (SEQ ID NO: 188); an amino acid sequence motif 11 as represented by an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); an amino acid sequence motif 17 as represented by an amino acid sequence of the formula D[GED][VAIL][QEAND][KQRN][TLSIV]FGDP[SHT][RDKE]P[APST]GE (SEQ ID NO: 189); an amino acid sequence motif 20 as represented by an amino acid sequence of the formula DT[QEND]SSSLSSSSSL[LSIVT]LPWSR[NSQT]GSLLPS[EKQDNR]S[LFIV] (SEQ ID NO: 192); an amino acid sequence motif 24 as represented by an amino acid sequence of the formula [AQN][RVKIL][VTILS]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196); and an amino acid sequence motif 26 as represented by an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197).

In some embodiments a PtIP-65 polypeptide comprises, sequentially from the N-terminus to the C-terminus of the PtIP-65 polypeptide, at least one amino acid sequence motif selected from: an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 as represented by an amino acid sequence of the formula F[STRK]Y[DYEWF][GQN][G-

SETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 6 as represented by an amino acid sequence of the formula R[GLIV][SETD]YSE[FYW]TFA[DETS]GERIT (SEQ ID NO: 178); an amino acid sequence motif 17 as represented by an amino acid sequence of the formula D[GED][VAIL][QEAND][KQRN][TLSIV]FGDP[SHT][RDKE]P[APST]GE (SEQ ID NO: 189); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 as represented by an amino acid sequence of the formula [AVSILT]SG[ILV][CWY][VAIL]G[IVLF][TILMRSVK] (SEQ ID NO: 188); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 11 as represented by an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); an amino acid sequence motif 5 as represented by an amino acid sequence of the formula [GQN][ILFV][EITDLVS][ATV-SIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 20 as represented by an amino acid sequence of the formula DT[QEND]SSSLSSSSSL[LSIVT]LPWSR[NSQT]GSLLPS[EKQDNR]S[LFIV] (SEQ ID NO: 192); an amino acid sequence motif 26 as represented by an amino acid sequence of the formula L[SVTIL]AL[PTS][YFRWK][RDGQKEN]G[NDITQELVS][VALI][NSRQTK][GD-NEQ]L[PFRSKT]F[NDETQS] (SEQ ID NO: 197) and an amino acid sequence motif 24 as represented by an amino acid sequence of the formula [AQN][RVKIL][VTILS]TT[ST][GH][GST][TRSK]FSF[SPT]GL[QHKNR]G[AFL-RIVK][FY]TG[QE DN]S[HYW][VAIL][IPLV][ADE][IVL]T[TAS]Q (SEQ ID NO: 196).

In some embodiments a PtIP-65 polypeptide comprises an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TV-SIL][PILV][VGIL][YTWS][VLI]IGGQGG[SNTQ][AQSNT] (SEQ ID NO: 184); an amino acid sequence motif 16 as represented by an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 8 as represented by an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180); ii) an amino acid sequence motif 13 as represented by an amino acid sequence of the formula GVDYTSVDI[TVIL][NSQT][TQSN]GTRSK[ADE] (SEQ ID NO: 185); iii) an amino acid sequence motif 19 as represented by an amino acid sequence of the formula [TS]G[DSTNQE][DS][TSNQ]P[AHYRITKLVS][TVLSI][FYC]G[TS][APVIL] (SEQ ID NO: 191); iv) an amino acid sequence motif 22 as represented by an amino acid sequence of the formula [KLSRIVT][DKNERQ][EHQND]VEV[EQDN]A[TVSIL][DE]QQ (SEQ ID NO: 194); and v) an amino acid sequence motif 23 as represented by an amino acid sequence of the formula Y[TAS][ST]TQEESRTLT (SEQ ID NO: 195).

In some embodiments a PtIP-65 polypeptide comprises an amino acid sequence motif 6 as represented by an amino acid sequence of the formula R[GLIV][SETD]YSE[FYW]TFA[DETS]GERIT (SEQ ID NO: 178); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVC-SILT]R[LMIV]I [NSQT]V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 as represented by an amino acid sequence of the formula [GQN][ILFV][EIT-DLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TV-SIL][PILV][VGIL][YTWS][VLI]IGGQGG[SNTQ][AQSNT] (SEQ ID NO: 184); an amino acid sequence motif 16 as represented by an amino acid sequence of the formula [AVSILT]SG[ILV][CWY][VAIL]G[IVLF][TILMRSVK] (SEQ ID NO: 188); an amino acid sequence motif 8 as represented by an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180); an amino acid sequence motif 13 as represented by an amino acid sequence of the formula GVDYTSVDI[TVIL][NSQT][TQSN]GTRSK[ADE] (SEQ ID NO: 185); an amino acid sequence motif 19 as represented by an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 22 as represented by an amino acid sequence of the formula [KLSRIVT][DKNERQ][EHQND]VEV[EQDN]A [TVSIL][DE]QQ (SEQ ID NO: 194); an amino acid sequence motif 23 as represented by an amino acid sequence of the formula Y[TAS][ST]TQEESRTLT (SEQ ID NO: 195); and at least one amino acid sequence motif selected from: i) an amino acid sequence motif 4 as represented by an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G [TDSE][VIL]F[QRNK]Y[PA][ILV][SKTR][SGT][MQN]Y (SEQ ID NO: 176); ii) an amino acid sequence motif 7 as represented by an amino acid sequence of the formula [NTQS]D[SKTR]NN[ADE][GDSET]S[IELVD][PST][KL-RIV]NW[TVSIL][FLIV][SAT]GSR[TQSN]VT[ITVLS]SS[ST]W[STRK][LTIVS]T (SEQ ID NO: 179); and iii) an amino acid sequence motif as represented by an amino acid sequence of the formula [LFIV][ED][QTNS][AQ]GI[IVSTL]P[VITQLSN][TAS]L[DKER] (SEQ ID NO: 187).

In some embodiments a PtIP-65 polypeptide comprises, sequentially from the N-terminus to the C-terminus of the PtIP-65 polypeptide, at least one amino acid sequence motif selected from: an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 as represented by an amino acid sequence of the formula F[STRK]Y[DYEWF][GQN][G-SETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 as represented by an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 as represented by an amino acid sequence of the formula R[GLIV][SETD]YSE[FYW]TFA[DETS]GERIT (SEQ ID NO: 178); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 as represented by an amino acid sequence of the formula [AVSILT]SG[ILV][CWY][VAIL]G[IVLF][TILMRSVK] (SEQ ID NO: 188); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 15 as represented by an amino acid sequence of the formula [LFIV][ED][QTNS][AQ]GI[IVSTL]P[VITQLSN][TAS]L[DKER] (SEQ ID NO: 187); an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G [EVDIL][FVIL]GW[SEQTDN][VIL]S[VAIL][ST] (SEQ ID NO: 177) an amino acid sequence motif 23 as represented by an amino acid sequence of the formula Y[TAS][ST]TQEESRTLT (SEQ ID NO: 195); an amino acid sequence motif 4 as represented by an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); an amino acid sequence motif 13 as represented by an amino acid sequence of the formula GVDYTSVDI[TVIL][NSQT][TQSN]GTRSK[ADE] (SEQ ID NO: 185); an amino acid sequence motif 22 as represented by an amino acid sequence of the formula [KLSRIVT][DKNERQ][EHQND]VEV[EQDN]A[TVSIL][DE]QQ (SEQ ID NO: 194); and an amino acid sequence motif 8 as represented by an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180).

In some embodiments a PtIP-65 polypeptide comprises, sequentially from the N-terminus to the C-terminus of the PtIP-65 polypeptide, at least one amino acid sequence motif selected from: an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 as represented by an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 as represented by an amino acid sequence of the formula R[GLIV][SETD]YSE[FYW]TFA[DETS]GERIT (SEQ ID NO: 178); an amino acid sequence motif 10 as represented by an amino acid sequence of the formula [WPYF][DTNQES][HNVQIL][VIL][AG]R[VIL][RWKYH]F[SQTN]TS[RLKIV][GLIV]R[TISLV]FE[YFW]G[SMT][ST][RV][EQND]P[ST]G[QKRN][WVYIL][FITLVS][TESD][VAIL]NVGSGVCVG[V MIL] (SEQ ID NO: 182); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 27 as represented by an amino acid sequence of the formula T[TFPS]IL[EQSDNT][EQHDN]LP[DAE] (SEQ ID NO: 198); an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 21 as represented by an amino acid sequence of the formula HL[TVSIL][GA][NRSQKT][ANDQE]I[STLIV][IVL][NDQE][VILM][DTSE]LGI [ND][TAS]P[TKSR][VIL]V[PA] (SEQ ID NO: 193); an amino acid sequence motif 18 as represented by an amino acid sequence of the formula G[TLPSIV][AED]GAST[NTAQS]F[GQHN]W[EQND]T[VAIL]R[TAS]FPS[TISLV]NA (SEQ ID NO: 190); an amino acid sequence motif 9 as represented by an amino acid sequence of the formula [IMVL][QEND]G[ST]I[AST][NDQE]L[TISLV]V[SRTK]T[NADQE][EAD]YSVW[CG]H[IVL]SDT[L VI]APAQ[SLTIV][LIV][PIVL][KSRT][HRK][RASVKTIL]A (SEQ ID NO: 181); an amino acid sequence motif 14 as represented by an amino acid sequence of the formula [LWIVF][VIL]GEG[RSKT]I[TDSE][ANQ]L[PQN]CSA[NRQK]QV[FILV]T[SDTE][GAST][GADE][NGYQ][NDGQE][LFIV]PF[AG][TS]F[ST]FPV[RGQKN][LSVIT][LFIV]Y[DNSQET][GA][GRK]AHS[DNQTES]VQ[VIL][LIV] (SEQ ID NO: 186).

In some embodiments a PtIP-65 polypeptide comprises an amino acid sequence motif 6 as represented by an amino acid sequence of the formula R[GLIV][SETD]YSE[FYW]

TFA[DETS]GERIT (SEQ ID NO: 178); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 as represented by an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 17 as represented by an amino acid sequence of the formula D[GED][VAIL][QEAND][KQRN][TLSIV]FGDP[SHT][RDKE]P[APST]GE (SEQ ID NO: 189); ii) an amino acid sequence motif 4 as represented by an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); iii) an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); and iv) an amino acid sequence motif 15 as represented by an amino acid sequence of the formula [LFIV][ED][QTNS][AQ]GI[IVSTL]P[VITQLSN][TAS]L[DKER] (SEQ ID NO: 187).

In some embodiments a PtIP-65 polypeptide comprises, sequentially from the N-terminus to the C-terminus of the PtIP-65 polypeptide, at least one amino acid sequence motif selected from: an amino acid sequence motif 12 as represented by an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 as represented by an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 6 as represented by an amino acid sequence of the formula R[GLIV][SETD]YSE[FYW]TFA[DETS]GERIT (SEQ ID NO: 178); an amino acid sequence motif 17 as represented by an amino acid sequence of the formula D[GED][VAIL][QEAND][KQRN][TLSIV]FGDP[SHT][RDKE]P[APST]GE (SEQ ID NO: 189); an amino acid sequence motif selected from: an amino acid sequence motif 1 as represented by an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 as represented by an amino acid sequence of the formula [AVSILT]SG[ILV][CWY][VAIL]G[IVLF][TILMRSVK] (SEQ ID NO: 188); an amino acid sequence motif 3 as represented by an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 15 as represented by an amino acid sequence of the formula [LFIV][ED][QTNS][AQ]GI[IVSTL]P[VITQLSN][TAS]L[DKER] (SEQ ID NO: 187); an amino acid sequence motif 7 as represented by an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 as represented by an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); and an amino acid sequence motif 4 as represented by an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); and at least one amino acid sequence motif selected from: i) an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); and ii) an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); and at least one amino acid sequence motif selected from: i) an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]

SWG[LKRIV][KQRN]TEYP[IVQLN]DV (SEQ ID NO: 173); ii) an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); iii) an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); and iv) an amino acid sequence motif 16 having at least 90% identity to an amino acid sequence of the formula [AVSILT]SG[ILV][CWY][VAIL]G[IVLF][TILMRSVK] (SEQ ID NO: 188).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEW-F][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I[NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYK-WF]F[YERDKWF]T[TNSQ][TQNS][GNQ][GRK][SRTK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 11 having at least 90% identity to an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); ii) an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); iii) an amino acid sequence motif 20 having at least 90% identity to an amino acid sequence of the formula DT[QEND]SSSLSSSSSL[LSIVT]LPWSR[NSQT]GSLLPS[EKQDNR]S[LFIV](SEQ ID NO: 192); iv) an amino acid sequence motif 24 having at least 90% identity to an amino acid sequence of the formula [AQN][RVKIL][VTILS]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196); and v) an amino acid sequence motif 26 having at least 90% identity to an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEW-F][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I[NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYK-WF]F[YERDKWF]T[TNSQ][TQNS][GNQ][GRK][SRTK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 11 having at least 90% identity to an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); an amino acid sequence motif 20 having at least 90% identity to an amino acid sequence of the formula DT[QEND]SSSLSSSSSL[LSIVT]LPWSR[NSQT]GSLLPS[EKQDNR]S[LFIV] (SEQ ID NO: 192); an amino acid sequence motif 24 having at least 90% identity to an amino acid sequence of the formula [AQN][RVKIL][VTILS]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196); and an amino acid sequence motif 26 having at least 90% identity to an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197).

In some embodiments a PtIP-65 polypeptide comprises, sequentially from the N-terminus to the C-terminus of the PtIP-65 polypeptide, an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW

[LMIV] (SEQ ID NO: 174); an amino acid sequence motif 6 having at least 90% identity to an amino acid sequence of the formula R[GLIV][SETD]YSE[FYW]TFA[DETS]GERIT (SEQ ID NO: 178); an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 11 having at least 90% identity to an amino acid sequence of the formula K[ST]F[NTQS]L[QGLNIV]N[TAS]A[DHNQE][QHN][DE]D[PQN]SST[EQND][QKNR]LAW[EQN D]LADEP[SRTK]FDNV[SFTWY][HLIV][ST]W[SITLV]LSN (SEQ ID NO: 183); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 20 having at least 90% identity to an amino acid sequence of the formula DT[QEND]SSSLSSSSSL[LSIVT]LPWSR[NSQT]GSLLPS[EKQDNR]S[LFIV] (SEQ ID NO: 192); an amino acid sequence motif 26 having at least 90% identity to an amino acid sequence of the formula L[SVTIL]AL[PTS][YFRWK][RDGQKEN]G[NDITQELVS][VALI][NSRQTK][GDNEQ]L[PFRSKT]F[NDETQS] (SEQ ID NO: 197) and an amino acid sequence motif 24 having at least 90% identity to an amino acid sequence of the formula [AQN][RVKIL][VTILS]TT[ST][GH][GST][TRSK]FSF[SPT]GL[QHKNR]G[AFLRIVK][FY]TG[QE DN]S[HYW][VAIL][IPLV][ADE][IVL]T[TAS]Q (SEQ ID NO: 196).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I[NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 8 having at least 90% identity to an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180); ii) an amino acid sequence motif 13 having at least 90% identity to an amino acid sequence of the formula GVDYTSVDI[TVIL][NSQT][TQSN]GTRSK[ADE] (SEQ ID NO: 185); iii) an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); iv) an amino acid sequence motif 22 having at least 90% identity to an amino acid sequence of the formula [KLSRIVT][DKNERQ][EHQND]VEV[EQDN]A[TVSIL][DE]QQ (SEQ ID NO: 194); and v) an amino acid sequence motif 23 having at least 90% identity to an amino acid sequence of the formula Y[TAS][ST]TQEESRTLT (SEQ ID NO: 195).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I[NSQT]V[QSNT]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 16 having at least 90% identity to an amino acid sequence [AVSILT]SG[ILV][CWY][VAIL]G[IVLF][TILMRSVK] (SEQ ID NO: 188); an amino acid sequence motif 8 having at least 90% identity to an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180); an amino acid sequence motif 13 having at least 90% identity to an amino acid sequence of the formula GVDYTSVDI[TVIL][NSQT][TQSN]GTRSK[ADE](SEQ ID NO: 185); an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 22 having at least 90% identity to an amino acid sequence of the formula [KLSRIVT][DKNERQ][EHQND]VEV[EQDN]A[TVSIL][DE]QQ (SEQ ID NO: 194); an amino acid sequence motif 23 having at least 90% identity to an amino acid sequence of the formula Y[TAS][ST]TQEESRTLT (SEQ ID NO: 195); and at least one amino acid sequence motif selected from: i) an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); ii) an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); and iii) an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187).

In some embodiments a PtIP-65 polypeptide comprises, sequentially from the N-terminus to the C-terminus of the PtIP-65 polypeptide, an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 having at least 90% identity to an amino acid sequence of the formula R[GLIV][SETD]YSE[FYW]TFA[DETS]GERIT (SEQ ID NO: 178); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187); an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 23 having at least 90% identity to an amino acid sequence of the formula Y[TAS][ST]TQEESRTLT (SEQ ID NO: 195); an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176); an amino acid sequence motif 13 having at least 90% identity to an amino acid sequence of the formula GVDYTSVDI[TVIL][NSQT][TQSN]GTRSK[ADE] (SEQ ID NO: 185); an amino acid sequence motif 22 having at least 90% identity to an amino acid sequence of the formula [KLSRIVT][DKNERQ][EHQND]VEV[EQDN]A[TVSIL][DE]QQ (SEQ ID NO: 194); and an amino acid sequence motif 8 having at least 90% identity to an amino acid sequence of the formula [QGN][EVD][GKR]D[HQN][NSQT]VQP[NDQE]KE[VAIL][EKQDRN]E[CRSKT][KTSR][LVI]LF[AITLVS]E (SEQ ID NO: 180).

In some embodiments a PtIP-65 polypeptide comprises, sequentially from the N-terminus to the C-terminus of the PtIP-65 polypeptide, an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 19 having at least 90% identity to an amino acid sequence of the formula [TS]G[DSTNQE][DS][TSNQ]P[AHYRITKLVS][TVLSI][FYC]G[TS][APVIL] (SEQ ID NO: 191); an amino acid sequence motif 6 having at least 90% identity to an amino acid sequence of the formula R[GLIV][SETD]YSE[FYW]TFA[DETS]GERIT (SEQ ID NO: 178); an amino acid sequence motif 10 having at least 90% identity to an amino acid sequence of the formula [WPYF][DTNQES][HNVQIL][VIL][AG]R[VIL][RWKYH]F[SQTN]TS[RLKIV][GLIV]R[TISLV]FE[YFW]G[SMT][ST][RV][EQND]P[ST]G[QKRN][WVYIL][FITLVS][TESD][VAIL]NVGSGVCVG[V MIL] (SEQ ID NO: 182); an amino acid sequence motif 3 having at least 90% identity to an amino acid sequence of GRA[NSQT][SVTIL]D[IVL][DNQE][SAT]LG[FVIL][VMLI]FLR[PTS]I[QAN]S[AVCSILT]R[LMIV]I [NSQT]V[QSN-T]YPTL (SEQ ID NO: 175); an amino acid sequence motif 27 having at least 90% identity to an amino acid sequence of the formula T[TFPS]IL[EQSDNT][EQHDN]LP[DAE] (SEQ ID NO: 198); an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 21 having at least 90% identity to an amino acid sequence of the formula HL[TVSIL][GA][NRSQKT][ANDQE]I[STLIV][IVL][NDQE][VILM][DTSE]LGI[ND][TAS]P[TKSR][VIL]V[PA] (SEQ ID NO: 193); an amino acid sequence motif 18 having at least 90% identity to an amino acid sequence of the formula G[TLPSIV][AED]GAST[NTAQS]F[GQHN]W[EQND]T[VAIL]R[TAS]FPS[TISLV]NA (SEQ ID NO: 190); an amino acid sequence motif 9 having at least 90% identity to an amino acid sequence of the formula [IMVL][QEND]G[ST]I[AST][NDQE]L[TISLV]V[SRTK]T[NADQE][EAD]YSVW[CG]H[IVL]SDT[L VI]APAQ[SLTIV][LIV][PIVL][KSRT][HRK][RASVKTIL]A (SEQ ID NO: 181); an amino acid sequence motif 14 having at least 90% identity to an amino acid sequence of the formula [LWIVF][VIL]GEG[RSKT]I[TDSE][ANQ]L[PQN]CSA[NRQK]IQV[FILV]T[SDTE][GAST][GADE][NGYQ][NDGQE][LFIV]PF[AG][TS]F[ST]FPV[RGQKN][LSVIT][LFIV]Y[DNSQET][GA][GRK]A HS[DNQTES]VQ[VIL][LIV] (SEQ ID NO: 186).

In some embodiments a PtIP-65 polypeptide comprises an amino acid sequence motif 6 having at least 90% identity to an amino acid sequence of the formula R[GLIV][SETD]YSE[FYW]TFA[DETS]GERIT (SEQ ID NO: 178); an amino acid sequence motif 2 having at least 90% identity to an amino acid sequence of the formula F[STRK]Y[DYEW-F][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 3 having at least 90% identity to an amino acid sequence of GRA[NSQT][SVTIL]D[IVL][DNQE][SAT]LG[FVIL][VMLI]FLR[PTS]I[QAN]S[AVCSILT]R[LMIV]I [NSQT]V[QSN-T]YPTL (SEQ ID NO: 175); an amino acid sequence motif selected from: an amino acid sequence motif 1 having at least 90% identity to an amino acid sequence of the formula RLSLWGNGAGTR[SAT]G[WAGYF]I[RYKWF]F[YE-RDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 5 having at least 90% identity to an amino acid sequence of the formula [GQN][ILFV][EITDLVS][ATV-SIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); an amino acid sequence motif 12 having at least 90% identity to an amino acid sequence of the formula [LMIV][AVYILF][QLNIV][TV-SIL][PILV][VGIL][YTWS][VLI]IGGQGG[SNTQ][AQSNT] (SEQ ID NO: 184); an amino acid sequence motif 16 having at least 90% identity to an amino acid sequence of the formula [AVSILT]SG[ILV][CWY][VAIL]G[IVLF][TILMRSVK] (SEQ ID NO: 188); and at least one amino acid sequence motif selected from: i) an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); ii) an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLN-RIV][SNTQ]G[TDSE][VIL]F[QRNK]Y[PA][ILV][SKTR][SGT][MQN]Y (SEQ ID NO: 176); iii) an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); and iv) an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187).

In some embodiments a PtIP-65 polypeptide comprises, sequentially from the N-terminus to the C-terminus of the PtIP-65 polypeptide: an amino acid sequence motif 12 having at least 90% identity to an amino acid sequence of the formula [LMIV][AVYILF][QLNIV][TVSIL][PILV][VGIL][YTWS][VLI]IGGQGG[SNTQ][AQSNT] (SEQ ID NO: 184); an amino acid sequence motif 2 having at least 90% identity to an amino acid sequence of the formula F[STRK]Y[DYEWF][GQN][GSETD][TRKS][DNQE]G[RK]V[LMIV][QTRNSK][RK]I[GRK]V[WY][ARK][GA][ETDS][SWTYF][RQKN][ILV][KR][AG]I[RESKDT]VW[LMIV] (SEQ ID NO: 174); an amino acid sequence motif 6 having at least 90% identity to an amino acid sequence of the formula R[GLIV][SETD]YSE[FYW]TFA[DETS]GERIT (SEQ ID NO: 178); an amino acid sequence motif 17 having at least 90% identity to an amino acid sequence of the formula D[GED][VAIL][QEAND][KQRN][TLSIV]FGDP[SHT][RDKE]P[APST]GE (SEQ ID NO: 189); an amino acid sequence motif selected from: an amino acid sequence motif 1 having at least 90% identity to an amino acid sequence of the formula RLSLWGNGAGTR[SAT]G[WAGYF]I[RYKWF]F[YERDKWF]T[TNSQ][TQNS][GNQ][GRK][SR TK]F[FDE][FPH][GKR]M[TYSWF]SWG[LKRIV][KQRN]TEYP[IVQLN]DV (SEQ ID NO: 173); an amino acid sequence motif 16 having at least 90% identity to an amino acid sequence of the formula [AVSILT]SG[ILV][CWY][VAIL]G[IVLF][TILMRSVK] (SEQ ID NO: 188); an amino acid sequence motif 3 having at least 90% identity to an amino acid sequence of the formula GRA[NSQT][SVTIL]D[IVL][DNQE][SAT]LG[FVIL][VMLI]FLR[PTS]I[QAN]S[AVCSILT]R[LMIV]I [NSQT]V[QSNT]YPTL (SEQ ID NO: 175); an amino acid sequence motif 15 having at least 90% identity to an amino acid sequence of the formula [LFIV][ED][QTNS][AQ]GI[IVSTL]P[VITQLSN][TAS]L[DKER] (SEQ ID NO: 187); an amino acid sequence motif 7 having at least 90% identity to an amino acid sequence of the formula [NTQS]D[SKTR]NN[ADE][GDSET]S[IELVD][PST][KLRIV]NW[TVSIL][FLIV][SAT]GSR[TQSN]VT[ITVLS]SS[ST]W[STRK][LTIVS]T (SEQ ID NO: 179); an amino acid sequence motif 5 having at least 90% identity to an amino acid sequence of the formula [GQN][ILFV][EITDLVS][ATVSIL][HTS][AST]S[VIL][TS]V[QESNDT]A[GRK]IP[AST][VLI]AEV[S NTQ]G[EVDIL][FVIL]GW[SEQTDN][VIL]S[VAIL][ST] (SEQ ID NO: 177); and an amino acid sequence motif 4 having at least 90% identity to an amino acid sequence of the formula W[NGQ][QVNIL]SGTL[ESDT][PA]G[QEND][WSYT]I[SHT][LIV][QKNR]A[TLSIV]TR[RK]G[TLS IV]I[TS][LVI]P[YFW]Q[GA][TS][MILV][EQND][IVL]TL[QKLNRIV][SNTQ]G[TDSE][VIL]F[QRNK]Y[PA][ILV][SKTR][SGT][MQN]Y (SEQ ID NO: 176).

In some embodiments a PtIP-65 polypeptide is about 300 to 400 amino acids in length having a consensus secondary structure comprising 13 to 17 segments of predominately beta strand structure separated by coil regions.

In some embodiments a PtIP-65 polypeptide comprises, sequentially from the N-terminus to the C-terminus; i) a beta strand-1 (β1) of between about 3 amino acids and about 9 amino acids in length, ii) a coil of between about 17 amino acids and about 21 amino acids in length; iii) a beta strand-2 (β2) of between about 7 amino acids and about 9 amino acids in length, iv) a coil of between about 3 amino acids and about 4 amino acids in length; v) a beta strand-3 (β3) of between about 9 amino acids and about 10 amino acids in length, vi) a coil of between about 2 amino acids and about 5 amino acids in length; vii) a beta strand-4 (β4) of between about 3 amino acids and about 8 amino acids in length, viii) a coil of between about 7 amino acids and about 13 amino acids in length; ix) a beta strand-5 (β5) of between about 3 amino acids and about 5 amino acids in length, x) a coil of between about 4 amino acids and about 5 amino acids in length; xi) a beta strand-6 (β6) of between about 8 amino acids and about 12 amino acids in length, xii) a coil of between about 5 amino acids and about 12 amino acids in length; xiii) a beta strand-7 (β7) of between about 9 amino acids and about 13 amino acids in length, xiv) a coil of about 4 amino acids in length; xv) a beta strand-8 (β1) of between about 3 amino acids and about 7 amino acids in length, xvi)

a coil of between about 5 amino acids and about 9 amino acids in length; xvii) a beta strand-9 (β9) of between about 3 amino acids and about 5 amino acids in length, xviii) a coil of between about 3 amino acids and about 6 amino acids in length; ixx) a beta strand-10 (β10) of between about 7 amino acids and about 13 amino acids in length, xx) a coil of between about 3 amino acids and about 8 amino acids in length; xxi) a beta strand-11 (β11) of between about 5 amino acids and about 18 amino acids in length, xxii) a coil of between about 10 amino acids and about 22 amino acids in length; xxiii) a beta strand-12 (β12) of between about 7 amino acids and about 12 amino acids in length, xxiv) a coil of between about 5 amino acids and about 13 amino acids in length; xxv) a beta strand-13 (β13) of between about 60 amino acids and about 90 amino acids in length, xxvi) a coil of between about 4 amino acids and about 8 amino acids in length; xxvii) a beta strand-14 (β14) of between about 22 amino acids and about 30 amino acids in length, xxviii) a coil of between about 3 amino acids and about 8 amino acids in length; and xxix) a beta strand-15 (β15) of between about 22 amino acids and about 26 amino acids in length. As used herein, the term "about" when used in the context of the lower/upper limit of the length of a secondary structural element means the greater of −/+an integer of up to −/+20% of the length of the secondary structural element or −/+1 amino acid. By means of example, a secondary structure element of between about 3 amino acids and about 23 amino acids in length means a secondary structure element of between 2 and 27 amino acids in length.

In some embodiments a PtIP-65 polypeptide has a calculated molecular weight of between about 25kD and about 50kD, between about 27.5kD and about 47.5kD, or between about 30kD and about 45kD.

In some embodiments the PtIP-65 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, but are not limited to solubility, folding, stability, and digestibility. In some embodiments the PtIP-65 polypeptide has increased digestibility of proteolytic fragments in an insect gut. Models for digestion by simulated gastric fluids are known to one skilled in the art (Fuchs, R. L. and J. D. Astwood. *Food Technology* 50: 83-88, 1996; Astwood, J. D., et al *Nature Biotechnology* 14: 1269-1273, 1996; Fu T J et al *J. Agric Food Chem.* 50: 7154-7160, 2002).

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In another aspect the PtIP-50 polypeptide or PtIP-65 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.,* 271: 22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterification reaction between the two termini to form a branched ester or thioester intermediate and peptide bond cleavage coupled to cyclization of the intein C-terminal asparagine to free the intein (Evans, et al., (2000) *J. Biol. Chem.,* 275: 9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273: 10567-10577; Cotton, et al., (1999) *J. Am. Chem. Soc.* 121:1100-1101; Evans, et al., (1999) *J. Biol. Chem.* 274: 18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207:187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.,* 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another aspect the PtIP-50 polypeptide or PtIP-65 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the PtIP-50 polypeptide or PtIP-65 polypeptide and the 3' intein coding sequence is linked to the 5' end of the second fragment coding for the C-terminal part of the PtIP-50 polypeptide or PtIP-65 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.ilrpietro/inteins/Intein-stable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387: 422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

In another aspect the PtIP-50 polypeptide is a circular permuted variant. In certain embodiments the PtIP-50 polypeptide is a circular permuted variant of the polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70.

In another aspect the PtIP-65 polypeptide is a circular permuted variant. In certain embodiments the PtIP-65 polypeptide is a circular permuted variant of the polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42.

The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or PtIP- to have a low degree of solvent exposure are more likely to be part of the so-called hydrophobic core of the protein and should also be avoided for selection of amino and carboxyl termini. In contrast, those regions that are known or PtIP- to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted PtIP-50 polypeptides or PtIP-65 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted PtIP-50 polypeptides or PtIP-65 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another aspect fusion proteins are provided that include within its amino acid sequence an amino acid sequence comprising a PtIP-50 polypeptide including but not limited to the polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70, and active fragments thereof.

In another aspect fusion proteins are provided that include within its amino acid sequence an amino acid sequence comprising a PtIP-65 polypeptide including but not limited to the polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42, and active fragments thereof.

Methods for design and construction of fusion proteins (and polynucleotides encoding same) are known to those of skill in the art. Polynucleotides encoding a PtIP-50 polypeptide or PtIP-65 polypeptide may be fused to signal sequences which will direct the localization of the PtIP-50 polypeptide or PtIP-65 polypeptide to particular compartments of a prokaryotic or eukaryotic cell and/or direct the secretion of the PtIP-50 polypeptide or PtIP-65 polypeptide of the embodiments from a prokaryotic or eukaryotic cell. For example, in *E. coli*, one may wish to direct the expression of the protein to the periplasmic space. Examples of signal sequences or proteins (or fragments thereof) to which the PtIP-50 polypeptide or PtIP-65 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the PtIP-50 polypeptide or PtIP-65 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art (see, U.S. Pat. No. 7,193,133). Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the PtIP-50 polypeptide or PtIP-65 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine codon of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9.

In some embodiments fusion proteins are provide comprising a PtIP-50 polypeptide or PtIP-65 polypeptide and an insecticidal polypeptide joined by an amino acid linker. In some embodiments fusion proteins are provide comprising a PtIP-50 polypeptide and a PtIP-65 polypeptide joined by an amino acid linker.

In some embodiments fusion proteins are provided represented by a formula selected from the group consisting of:

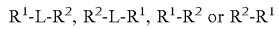

$R^1$-L-$R^2$, $R^2$-L-$R^1$, $R^1$-$R^2$ or $R^2$-$R^1$ wherein $R^1$ is a PtIP-50 polypeptide, $R^2$ is PtIP-65 polypeptide. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which R¹ and R² are bound by amide bonds linking the carboxy terminus of R¹ to the amino terminus of L and carboxy terminus of L to the amino terminus of R². By "fused in frame" is meant that there is no translation termination or disruption between the reading frames of R¹ and R². The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of R¹ and R² such that R¹ and R² could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pIII protein of the filamentous bacteriophages, e.g. bacteriophages M13 or fd (Schaller, et al., 1975). This region provides a long, flexible spacer region between two domains of the pIII surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN (SEQ ID NO: 201) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

In another aspect chimeric PtIP-50 polypeptides are provided that are created through joining two or more portions of PtIP-50 genes, which originally encoded separate PtIP-50 proteins to create a chimeric gene. The translation of the chimeric gene results in a single chimeric PtIP-50 polypeptide with regions, motifs or domains derived from each of the original polypeptides. In certain embodiments the chimeric protein comprises portions, motifs or domains of the PtIP-50 polypeptides of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 in any combination.

In another aspect chimeric PtIP-65 polypeptides are provided that are created through joining two or more portions of PtIP-65 genes, which originally encoded separate PtIP-65 proteins to create a chimeric gene. The translation of the chimeric gene results in a single chimeric PtIP-65 polypeptide with regions, motifs or domains derived from each of the original polypeptides. In certain embodiments the chimeric protein comprises portions, motifs or domains of the PtIP-65 polypeptides of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 in any combination.

It is recognized that DNA sequences may be altered by various methods, and that these alterations may result in DNA sequences encoding proteins with amino acid sequences different than that encoded by the wild-type (or native) pesticidal protein. In some embodiments a PtIP-50 polypeptide or PtIP-65 polypeptide may be altered in various ways including amino acid substitutions, deletions, truncations and insertions of one or more amino acids, including up to 2, 3, 4, 5, 6, 7, 8, 9, 10, 15, 20, 25, 30, 35, 40, 45, 50, 55, 60, 65, 70, 75, 80, 85, 90, 100, 105, 110, 115, 120, 125, 130, 135, 140, 145 or more amino acid substitutions, deletions and/or insertions or combinations thereof compared to any one of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42.

In some embodiments a PtIP-50 polypeptide or PtIP-65 polypeptide comprises a deletion of 1, 2, 3, 4, 5, 6, 7, 8, 9, 10, 11, 12, 13, 14, 15 or more amino acids from the N-terminus of the PtIP-50 polypeptide relative to the amino acid position of any one of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42.

Methods for such manipulations are generally known in the art. For example, amino acid sequence variants of a PtIP-50 polypeptide or PtIP-65 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of a PtIP-50 polypeptide or PtIP-65 polypeptide to confer pesticidal activity may be improved by the use of such techniques upon the compositions of this disclosure.

For example, conservative amino acid substitutions may be made at one or more, PtIP-, nonessential amino acid residues. A "nonessential" amino acid residue is a residue that can be altered from the wild-type sequence of a PtIP-50 polypeptide or PtIP-65 polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different PtIP-50 polypeptide coding regions or one or more different PtIP-65 polypeptide coding regions can be used to create a new PtIP-50 polypeptide or PtIP-65 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered PtIP-50 polypeptides or PtIP-65 polypeptides. Domains may be swapped between PtIP-50 polypeptides or between PtIP-65 polypeptides, resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Alignment of PtIP-50 homologs (FIGS. 10*a*-10*o*, 11*a*-11*f*, 12*a*-12*j*, 13*a*-13*e*, 14*a*-14*e*, 15*a*-15*e*) allowed for identification of residues that are highly conserved among natural homologs in this family. Alignment of PtIP-65 homologs (FIGS. 3*a*-3*i*, 4*a*-4*b*, 5*a*-5*c*, 6*a*-6*c*, 7, 8*a*-8*b*) allowed for identification of residues that are highly conserved among natural homologs in this family.

Compositions

Compositions comprising a PtIP-50 polypeptide and a PtIP-65 polypeptide of the disclosure are also embraced. In some embodiments the composition comprises a PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and a PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42. In some embodiments the composition comprises a PtIP-50/PtIP-65 fusion protein.

Antibodies

Antibodies to a PtIP-50 polypeptide or a PtIP-65 polypeptide of the embodiments or to variants or fragments thereof are also encompassed. The antibodies of the disclosure include polyclonal and monoclonal antibodies as well as fragments thereof which retain their ability to bind to PtIP-50 polypeptide or a PtIP-65 polypeptide found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. PtIP-50 polypeptide or PtIP-65 polypeptide antibodies or antigen-binding portions thereof can be produced by a variety of techniques, including conventional monoclonal antibody methodology, for example the standard somatic cell hybridization technique of Kohler and Milstein, (1975) *Nature* 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing a PtIP-50 polypeptide or PtIP-65 polypeptide as antigens.

A kit for detecting the presence of a PtIP-50 polypeptide or a PtIP-65 polypeptide or detecting the presence of a nucleotide sequence encoding a PtIP-50 polypeptide or a PtIP-65 polypeptide, in a sample is provided. In one embodiment, the kit provides antibody-based reagents for detecting the presence of a PtIP-50 polypeptide or a PtIP-65 polypeptide in a tissue sample. In another embodiment, the kit provides labeled nucleic acid probes useful for detecting the presence of one or more polynucleotides encoding PtIP-50 polypeptide or a PtIP-65 polypeptide. The kit is provided along with appropriate reagents and controls for carrying out a detection method, as well as instructions for use of the kit.

Receptor Identification and Isolation

Receptors to the PtIP-50 polypeptide and/or a PtIP-65 polypeptide of the embodiments or to variants or fragments thereof, are also encompassed. Methods for identifying receptors are well known in the art (see, Hofmann, et. al., (1988) *Eur. J. Biochem.* 173:85-91; Gill, et al., (1995) *J. Biol. Chem.* 27277-27282) can be employed to identify and isolate the receptor that recognizes the PtIP-50 polypeptide and/or the PtIP-65 polypeptide using the brush-border membrane vesicles from susceptible insects. In addition to the radioactive labeling method listed in the cited literatures, PtIP-50 polypeptide or a PtIP-65 polypeptide can be labeled with fluorescent dye and other common labels such as biotin. Brush-border membrane vesicles (BBMV) of susceptible insects such as soybean looper and stink bugs can be prepared according to the protocols listed in the references and separated on SDS-PAGE gel and blotted on suitable membrane. Labeled PtIP-50 polypeptide or a PtIP-65 polypeptides can be incubated with blotted membrane of BBMV and labeled the PtIP-50 polypeptide or a PtIP-65 polypeptides can be identified with the labeled reporters. Identification of protein band(s) that interact with the PtIP-50 polypeptide or a PtIP-65 polypeptide can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the PtIP-50 polypeptide or a PtIP-65 polypeptide. Receptor function for insecticidal activity by the PtIP-50 polypeptide or a PtIP-65 polypeptide can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the PtIP-50 polypeptide or a PtIP-65 polypeptide gene sequence to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof). Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gown, (1990) *Plant Physiol.* 92:1-11 for a discussion of host-preferred codon usage. For example, although nucleic acid sequences of the embodiments may be expressed in both monocotyledonous and dicotyledonous plant species, sequences can be modified to account for the specific codon preferences and GC content preferences of monocotyledons or dicotyledons as these preferences have been shown to differ (Murray et al. (1989) *Nucleic Acids Res.* 17:477-498). Thus, the maize-preferred codon for a particular amino acid may be derived from known gene sequences from maize. Maize codon usage for 28 genes from maize plants is listed in Table 4 of Murray, et al., supra. Methods are available in the art for synthesizing plant-preferred genes. See, for example, U.S. Pat. Nos. 5,380,831, and 5,436,391 and Murray, et al., (1989) *Nucleic Acids Res.* 17:477-498, and Liu H et al. *Mol Bio Rep* 37:677-684, 2010, herein incorporated by reference. A *Zea maize* codon usage table can be also found at kazusa.or.jp/codon/cgi-bin/showcodon.cgi?species=4577, which can be accessed using the www prefix. Table 4 shows a maize optimal codon analysis (adapted from Liu H et al. *Mol Bio Rep* 37:677-684, 2010).

TABLE 4

| Amino Acid | Codon | High Count | RSCU | Low Count | RSCU | Amino Acid | Codon | High Count | RSCU | Low Count | RSCU |
|---|---|---|---|---|---|---|---|---|---|---|---|
| Phe | UUU | 115 | 0.04 | 2,301 | 1.22 | Ala | GCU | 629 | 0.17 | 3,063 | 1.59 |
|  | UUC* | 5,269 | 1.96 | 1,485 | 0.78 |  | GCC* | 8,057 | 2.16 | 1,136 | 0.59 |
| Ser | UCU | 176 | 0.13 | 2,498 | 1.48 |  | GCA | 369 | 0.1 | 2,872 | 1.49 |
|  | UCC* | 3,489 | 2.48 | 1,074 | 0.63 |  | GCG* | 5,835 | 1.57 | 630 | 0.33 |
|  | UCA | 104 | 0.07 | 2,610 | 1.54 | Tyr | UAU | 71 | 0.04 | 1,632 | 1.22 |
|  | UCG* | 1,975 | 1.4 | 670 | 0.4 |  | UAC* | 3,841 | 1.96 | 1,041 | 0.78 |
|  | AGU | 77 | 0.05 | 1,788 | 1.06 | His | CAU | 131 | 0.09 | 1,902 | 1.36 |
|  | AGC* | 2,617 | 1.86 | 1,514 | 0.89 |  | CAC* | 2,800 | 1.91 | 897 | 0.64 |
| Leu | UUA | 10 | 0.01 | 1,326 | 0.79 | Cys | UGU | 52 | 0.04 | 1,233 | 1.12 |
|  | UUG | 174 | 0.09 | 2,306 | 1.37 |  | UGC* | 2,291 | 1.96 | 963 | 0.88 |
|  | CUU | 223 | 0.11 | 2,396 | 1.43 | Gln | CAA | 99 | 0.05 | 2,312 | 1.04 |
|  | CUC* | 5,979 | 3.08 | 1,109 | 0.66 |  | CAG* | 3,557 | 1.95 | 2,130 | 0.96 |
|  | CUA | 106 | 0.05 | 1,280 | 0.76 | Arg | CGU | 153 | 0.12 | 751 | 0.74 |
|  | CUG* | 5,161 | 2.66 | 1,646 | 0.98 |  | CGC* | 4,278 | 3.25 | 466 | 0.46 |
| Pro | CCU | 427 | 0.22 | 1,900 | 1.47 |  | CGA | 92 | 0.07 | 659 | 0.65 |
|  | CCC* | 3,035 | 1.59 | 601 | 0.47 |  | CGG* | 1,793 | 1.36 | 631 | 0.62 |
|  | CCA | 311 | 0.16 | 2,140 | 1.66 |  | AGA | 83 | 0.06 | 1,948 | 1.91 |
|  | CCG* | 3,846 | 2.02 | 513 | 0.4 |  | AGG* | 1,493 | 1.14 | 1,652 | 1.62 |
| Ile | AUU | 138 | 0.09 | 2,388 | 1.3 | Asn | AAU | 131 | 0.07 | 3,074 | 1.26 |
|  | AUC* | 4,380 | 2.85 | 1,353 | 0.74 |  | AAC* | 3,814 | 1.93 | 1,807 | 0.74 |
|  | AUA | 88 | 0.06 | 1,756 | 0.96 | Lys | AAA | 130 | 0.05 | 3,215 | 0.98 |
| Thr | ACU | 136 | 0.09 | 1,990 | 1.43 |  | AAG* | 5,047 | 1.95 | 3,340 | 1.02 |
|  | ACC* | 3,398 | 2.25 | 991 | 0.71 | Asp | GAU | 312 | 0.09 | 4,217 | 1.38 |
|  | ACA | 133 | 0.09 | 2,075 | 1.5 |  | GAC* | 6,729 | 1.91 | 1,891 | 0.62 |
|  | ACG* | 2,378 | 1.57 | 495 | 0.36 | Gly | GGU | 363 | 0.13 | 2,301 | 1.35 |
| Val | GUU | 182 | 0.07 | 2,595 | 1.51 |  | GGC* | 7,842 | 2.91 | 1,282 | 0.75 |
|  | GUC* | 4,584 | 1.82 | 1,096 | 0.64 |  | GGA | 397 | 0.15 | 2,044 | 1.19 |
|  | GUA | 74 | 0.03 | 1,325 | 0.77 |  | GGG* | 2,186 | 0.81 | 1,215 | 0.71 |
|  | GUG* | 5,257 | 2.08 | 1,842 | 1.07 | Glu | GAA | 193 | 0.06 | 4,080 | 1.1 |
|  |  |  |  |  |  |  | GAG* | 6,010 | 1.94 | 3,307 | 0.9 |

Codon usage was compared using Chi squared contingency test to identify optimal codons. Codons that occur significantly more often (P\0.01) are indicated with an asterisk.

A *Glycine max* codon usage table is shown in Table 5 and can also be found at kazusa.or.jp/codon/cgi-bin/showcodon.cgi?species=3847&aa=1&style=N, which can be accessed using the www prefix.

TABLE 5

| TTT | F | 21.2 | (10493) | TCT | S | 18.4 | (9107) |
| TTC | F | 21.2 | (10487) | TCC | S | 12.9 | (6409) |
| TTA | L | 9.2 | (4545) | TCA | S | 15.6 | (7712) |
| TTG | L | 22.9 | (11340) | TCG | S | 4.8 | (2397) |
| CTT | L | 23.9 | (11829) | CCT | P | 18.9 | (9358) |
| CTC | L | 17.1 | (8479) | CCC | P | 10.1 | (5010) |
| CTA | L | 8.5 | (4216) | CCA | P | 19.1 | (9461) |
| CTG | L | 12.7 | (6304) | CCG | P | 4.7 | (2312) |
| ATT | I | 25.1 | (12411) | ACT | T | 17.1 | (8490) |
| ATC | I | 16.3 | (8071) | ACC | T | 14.3 | (7100) |
| ATA | I | 12.9 | (6386) | ACA | T | 14.9 | (7391) |
| ATG | M | 22.7 | (11218) | ACG | T | 4.3 | (2147) |
| GTT | V | 26.1 | (12911) | GCT | A | 26.7 | (13201) |
| GTC | V | 11.9 | (5894) | GCC | A | 16.2 | (8026) |
| GTA | V | 7.7 | (3803) | GCA | A | 21.4 | (10577) |
| GTG | V | 21.4 | (10610) | GCG | A | 6.3 | (3123) |
| TAT | Y | 15.7 | (7779) | TGT | C | 8.1 | (3995) |
| TAC | Y | 14.9 | (7367) | TGC | C | 8.0 | (3980) |
| TAA | * | 0.9 | (463) | TGA | * | 1.0 | (480) |
| TAG | * | 0.5 | (263) | TGG | W | 13.0 | (6412) |
| CAT | H | 14.0 | (6930) | CGT | R | 6.6 | (3291) |
| CAC | H | 11.6 | (5759) | CGC | R | 6.2 | (3093) |
| CAA | Q | 20.5 | (10162) | CGA | R | 4.1 | (2018) |
| CAG | Q | 16.2 | (8038) | CGG | R | 3.1 | (1510) |
| AAT | N | 22.4 | (11088) | AGT | S | 12.6 | (6237) |
| AAC | N | 22.8 | (11284) | AGC | S | 11.3 | (5594) |
| AAA | K | 26.9 | (13334) | AGA | R | 14.8 | (7337) |
| AAG | K | 35.9 | (17797) | AGG | R | 13.3 | (6574) |
| GAT | D | 32.4 | (16040) | GGT | G | 20.9 | (10353) |
| GAC | D | 20.4 | (10097) | GGC | G | 13.4 | (6650) |
| GAA | E | 33.2 | (16438) | GGA | G | 22.3 | (11022) |
| GAG | E | 33.2 | (16426) | GGG | G | 13.0 | (6431) |

In some embodiments the recombinant nucleic acid molecule encoding a PtIP-50 polypeptide or a PtIP-65 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as E. coli or eukaryotic cells such as yeast, insect, amphibian or mammalian cells or monocotyledonous or dicotyledonous plant cells. An example of a monocotyledonous host cell is a maize host cell. When possible, the sequence is modified to avoid PtIP-hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) Proc. Natl. Acad. Sci. USA 86:6126-6130); potyvirus leaders, for example, TEV leader (Tobacco Etch Virus) (Gallie, et al., (1995) Gene 165(2):233-238), MDMV leader (Maize Dwarf Mosaic Virus), human immunoglobulin heavy-chain binding protein (BiP) (Macejak, et al., (1991) Nature 353:90-94); untranslated leader from the coat protein mRNA of alfalfa mosaic virus (AMV RNA 4) (Jobling, et al., (1987) Nature 325:622-625); tobacco mosaic virus leader (TMV) (Gallie, et al., (1989) in Molecular Biology of RNA, ed. Cech (Liss, New York), pp. 237-256) and maize chlorotic mottle virus leader (MCMV) (Lommel, et al., (1991) Virology 81:382-385). See also, Della-Cioppa, et al., (1987) Plant Physiol. 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are protolytically activated in the gut of the target pest (Chang, (1987) Methods Enzymol. 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. FEBS LETT 480:271-276, 2000; Peltier et al. Plant Cell 12:319-341, 2000; Bricker et al. Biochim. Biophys Acta 1503:350-356, 2001), the lumen targeting signal peptide of which can potentially be used in accordance with the present disclosure. About 80 proteins from Arabidopsis, as well as homologous proteins from spinach and garden pea, are reported by Kieselbach et al., Photosynthesis Research, 78:249-264, 2003. In particular, Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, Science 296:92-100, 2002) is a suitable source for lumen targeting signal peptide which may be used in accordance with the present disclosure.

Suitable chloroplast transit peptides (CTP) are well known to one skilled in the art also include chimeric CTPs comprising but not limited to, an N-terminal domain, a central domain or a C-terminal domain from a CTP from Oryza sativa 1-deoxy-D xyulose-5-Phosphate Synthase Oryza sativa-Superoxide dismutase Oryza sativa-soluble starch synthase Oryza sativa-NADP-dependent Malic acid enzyme Oryza sativa-Phospho-2-dehydro-3-deoxyheptonate Aldolase 2 Oryza sativa-L-Ascorbate peroxidase 5 Oryza sativa-Phosphoglucan water dikinase, Zea Mays ssRUBISCO, Zea Mays-beta-glucosidase, Zea Mays-Malate dehydrogenase, Zea Mays Thioredoxin M-type US Patent Application Publication 2012/0304336).

The PtIP-50 polypeptide or a PtIP-65 polypeptide gene to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) Nature 313:810-812); rice actin (McElroy, et al., (1990) Plant Cell 2:163-171); ubiquitin (Christensen, et al., (1989) Plant Mol. Biol. 12:619-632 and Christensen, et al., (1992) Plant Mol. Biol. 18:675-689); pEMU (Last, et al., (1991) Theor. Appl. Genet. 81:581-588); MAS (Velten, et al., (1984) EMBO J. 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4:645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced PtIP-50 polypeptide or a PtIP-65 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7):792-803; Hansen, et al., (1997) *Mol. Gen Genet.* 254(3):337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5):773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2):343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691). See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein);

and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis, p26*, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about $\frac{1}{1000}$ transcripts to about $\frac{1}{100,000}$ transcripts to about $\frac{1}{500,000}$ transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608, 144; 5,604,121; 5,569,597; 5,466,785; 5,399,680; 5,268, 463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248: 480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat.

Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Biotechnology* 6:923-926) and Lec1 transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, New York), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the PtIP-50 polypeptide or a PtIP-65 polypeptide or variants and fragments thereof directly into the plant or the introduction of the PtIP-50 polypeptide or a PtIP-65 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107:775-784, all of which are herein incorporated by reference. Alternatively, the PtIP-50 polypeptide and/or the PtIP-65 polypeptide polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired PtIP-50 polypeptide or a PtIP-65 polypeptide. It is also recognized that such a viral polyprotein, comprising at least a portion of the amino acid sequence of a PtIP-50 polypeptide or a PtIP-65 polypeptide of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and *chrysanthemum*. Conifers that may be employed in practicing the embodiments include, for example, pines such as loblolly pine (*Pinus taeda*), slash pine (*Pinus ellioth*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*);

weeping alkaligrass (*Puccinellia distans*); western wheatgrass (*Agropyron smithii*); Bermuda grass (*Cynodon* spp.); St. Augustine grass (*Stenotaphrum secundatum*); *zoysia* grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore *paspalum* (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, *sorghum*, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mungbean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the PtIP-50 polypeptide or the PtIP-65 polypeptide.

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the PtIP-50 polypeptide or the PtIP-65 polypeptide disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262: 1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens,* 7:1-13), from *Pseudomonas protegens* strain CHAO and Pf-5 (previously *fluorescens*) (Pechy-Tarr, (2008) *Environmental Microbiology* 10:2368-2386: GenBank Accession No. EU400157); from *Pseudomonas Taiwanensis* (Liu, et al., (2010) *J. Agric. Food Chem.* 58:12343-12349) and from *Pseudomonas pseudoalcligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. Nos. 6,048,838, and 6,379,946; a PIP-1 polypeptide of U.S. Ser. No. 13/792,861; an AfIP-1A and/or AfIP-1B polypeptide of U.S. Ser. No. 13/800,233; a PHI-4 polypeptide of U.S. Ser. No. 13/839,702; and δ-endotoxins including, but not limited to, the Cry1, Cry2, Cry3, Cry4, Cry5, Cry6, Cry7, Cry8, Cry9, Cry10, Cry1I, Cry12, Cry13, Cry14, Cry15, Cry16, Cry17, Cry18, Cry19, Cry20, Cry21, Cry22, Cry23, Cry24, Cry25, Cry26, Cry27, Cry 28, Cry 29, Cry 30, Cry31, Cry32, Cry33, Cry34, Cry35, Cry36, Cry37, Cry38, Cry39, Cry40, Cry41, Cry42, Cry43, Cry44, Cry45, Cry 46, Cry47, Cry49, Cry 51 and Cry55 classes of 5-endotoxin genes and the *B. thuringiensis* cytolytic Cyt1 and Cyt2 genes. Members of these classes of *B. thuringiensis* insecticidal proteins include, but are not limited to Cry1Aa1 (Accession # AAA22353); Cry1Aa2 (Accession # Accession # AAA22552); Cry1Aa3 (Accession # BAA00257); Cry1Aa4 (Accession # CAA31886); Cry1Aa5 (Accession # BAA04468); Cry1Aa6 (Accession # AAA86265); Cry1Aa7 (Accession # AAD46139); Cry1Aa8 (Accession # I26149); Cry1Aa9 (Accession # BAA77213); Cry1Aa10 (Accession # AAD55382); Cry1Aa11 (Accession # CAA70856); Cry1Aa12 (Accession # AAP80146); Cry1Aa13 (Accession # AAM44305); Cry1Aa14 (Accession # AAP40639); Cry1Aa15 (Accession # AAY66993); Cry1Aa16 (Accession # HQ439776); Cry1Aa17 (Accession # HQ439788); Cry1Aa18 (Accession # HQ439790); Cry1Aa19 (Accession # HQ685121); Cry1Aa20 (Accession # JF340156); Cry1Aa21 (Accession # JN651496); Cry1Aa22 (Accession # KC158223); Cry1Ab1 (Accession # AAA22330); Cry1Ab2 (Accession # AAA22613); Cry1Ab3 (Accession # AAA22561); Cry1Ab4 (Accession # BAA00071); Cry1Ab5 (Accession # CAA28405); Cry1Ab6 (Accession # AAA22420); Cry1Ab7 (Accession # CAA31620); Cry1Ab8 (Accession # AAA22551); Cry1Ab9 (Accession # CAA38701); Cry1Ab10 (Accession # A29125); Cry1Ab11 (Accession # I12419); Cry1Ab12 (Accession # AAC64003); Cry1Ab13 (Accession # AAN76494); Cry1Ab14 (Accession # AAG16877); Cry1Ab15 (Accession # AAO13302); Cry1Ab16 (Accession # AAK55546); Cry1Ab17 (Accession # AAT46415); Cry1Ab18 (Accession # AAQ88259); Cry1Ab19 (Accession # AAW31761); Cry1Ab20 (Accession # ABB72460); Cry1Ab21 (Accession # ABS18384); Cry1Ab22 (Accession # ABW87320); Cry1Ab23 (Accession # HQ439777); Cry1Ab24 (Accession # HQ439778); Cry1Ab25 (Accession # HQ685122); Cry1Ab26 (Accession # HQ847729); Cry1Ab27 (Accession # JN135249); Cry1Ab28 (Accession # JN135250); Cry1Ab29 (Accession # JN135251); Cry1Ab30 (Accession # JN135252); Cry1Ab31 (Accession # JN135253); Cry1Ab32 (Accession # JN135254); Cry1Ab33 (Accession # AAS93798); Cry1Ab34 (Accession # KC156668); Cry1Ab-like (Accession # AAK14336); Cry1Ab-like (Accession # AAK14337); Cry1Ab-like (Accession # AAK14338); Cry1Ab-like (Accession # ABG88858); Cry1Ac1 (Accession # AAA22331); Cry1Ac2 (Accession # AAA22338); Cry1Ac3 (Accession # CAA38098); Cry1Ac4 (Accession # AAA73077); Cry1Ac5 (Accession # AAA22339); Cry1Ac6 (Accession # AAA86266); Cry1Ac7 (Accession # AAB46989); Cry1Ac8 (Accession # AAC44841); Cry1Ac9 (Accession # AAB49768); Cry1Ac10 (Accession # CAA05505); Cry1Ac11 (Accession # CAA10270); Cry1Ac12 (Accession # I12418); Cry1Ac13 (Accession # AAD38701); Cry1Ac14 (Accession # AAQ06607); Cry1Ac15 (Accession # AAN07788); Cry1Ac16 (Accession # AAU87037); Cry1Ac17 (Accession # AAX18704); Cry1Ac18 (Accession # AAY88347); Cry1Ac19 (Accession # ABD37053); Cry1Ac20 (Accession # ABB89046); Cry1Ac21 (Accession # AAY66992); Cry1Ac22 (Accession # ABZ01836); Cry1Ac23 (Accession # CAQ30431); Cry1Ac24 (Accession # ABL01535); Cry1Ac25 (Accession # FJ513324); Cry1Ac26 (Accession # FJ617446); Cry1Ac27 (Accession # FJ617447); Cry1Ac28 (Accession # ACM90319); Cry1Ac29 (Accession # DQ438941); Cry1Ac30 (Accession # GQ227507); Cry1Ac31 (Accession # GU446674); Cry1Ac32 (Accession # HM061081); Cry1Ac33 (Accession # GQ866913); Cry1Ac34 (Accession # HQ230364); Cry1Ac35 (Accession # JF340157); Cry1Ac36 (Accession # JN387137); Cry1Ac37 (Accession # JQ317685); Cry1Ad1 (Accession # AAA22340); Cry1Ad2 (Accession # CAA01880); Cry1Ae1 (Accession # AAA22410); Cry1Af1 (Accession # AAB82749); Cry1Ag1 (Accession # AAD46137); Cry1Ah1 (Accession # AAQ14326); Cry1Ah2 (Accession # ABB76664); Cry1Ah3 (Accession # HQ439779); Cry1Ai1 (Accession # AAO39719); Cry1Ai2 (Accession # HQ439780); Cry1A-like (Accession # AAK14339); Cry1Ba1 (Accession # CAA29898); Cry1Ba2 (Accession # CAA65003); Cry1Ba3 (Accession # AAK63251); Cry1Ba4 (Accession # AAK51084); Cry1Ba5 (Accession # ABO20894); Cry1Ba6 (Accession # ABL60921); Cry1Ba7 (Accession # HQ439781); Cry1Bb1 (Accession # AAA22344); Cry1Bb2 (Accession # HQ439782); Cry1Bc1 (Accession # CAA86568); Cry1Bd1 (Accession # AAD10292); Cry1Bd2 (Accession # AAM93496); Cry1Be1 (Accession # AAC32850); Cry1Be2 (Accession ns# AAQ52387); Cry1Be3 (Accession # ACV96720); Cry1Be4 (Accession # HM070026); Cry1Bf1 (Accession # CAC50778); Cry1Bf2 (Accession # AAQ52380); Cry1Bg1 (Accession # AAO39720); Cry1Bh1 (Accession # HQ589331); Cry1Bi1 (Accession # KC156700); Cry1Ca1 (Accession # CAA30396); Cry1Ca2 (Accession # CAA31951); Cry1Ca3 (Accession # AAA22343); Cry1Ca4 (Accession # CAA01886); Cry1Ca5 (Accession # CAA65457); Cry1Ca6 [1] (Accession # AAF37224); Cry1Ca7 (Accession # AAG50438); Cry1Ca8 (Accession # AAM00264); Cry1Ca9 (Accession # AAL79362); Cry1Ca10 (Accession # AAN16462); Cry1Ca11 (Accession # AAX53094); Cry1Ca12 (Accession # HM070027); Cry1Ca13 (Accession # HQ412621); Cry1Ca14 (Accession # JN651493); Cry1Cb1 (Accession # M97880); Cry1Cb2 (Accession # AAG35409); Cry1Cb3 (Accession # ACD50894); Cry1Cb-like (Accession # AAX63901); Cry1Da1 (Accession # CAA38099); Cry1Da2 (Accession # I76415); Cry1Da3 (Accession # HQ439784); Cry1Db1 (Accession # CAA80234); Cry1Db2 (Accession # AAK48937); Cry1Dc1 (Accession # ABK35074); Cry1Ea1 (Accession # CAA37933); Cry1Ea2 (Accession # CAA39609); Cry1Ea3 (Accession # AAA22345); Cry1Ea4 (Accession # AAD04732); Cry1Ea5 (Accession # A15535); Cry1Ea6 (Accession # AAL50330); Cry1Ea7 (Accession # AAW72936); Cry1Ea8 (Accession # ABX11258); Cry1Ea9 (Accession # HQ439785); Cry1Ea10 (Accession # ADR00398); Cry1Ea11 (Accession # JQ652456); Cry1Eb1 (Accession # AAA22346); Cry1Fa1 (Accession # AAA22348); Cry1Fa2 (Accession # AAA22347); Cry1Fa3 (Accession # HM070028); Cry1Fa4 (Accession # HM439638); Cry1Fb1 (Accession # CAA80235); Cry1Fb2 (Accession # BAA25298); Cry1Fb3 (Accession # AAF21767); Cry1Fb4 (Accession # AAC10641); Cry1Fb5 (Accession # AAO13295); Cry1Fb6 (Accession # ACD50892); Cry1Fb7 (Accession # ACD50893); Cry1Ga1 (Accession # CAA80233); Cry1Ga2 (Accession # CAA70506); Cry1Gb1 (Accession # AAD10291); Cry1Gb2 (Accession # AAO13756); Cry1Gc1 (Accession # AAQ52381); Cry1Ha1 (Accession # CAA80236); Cry1Hb1 (Accession # AAA79694); Cry1Hb2 (Accession # HQ439786); Cry1H-like (Accession # AAF01213); Cry1Ia1 (Accession # CAA44633); Cry1Ia2 (Accession # AAA22354); Cry1Ia3 (Accession # AAC36999); Cry1Ia4 (Accession # AAB00958); Cry1Ia5 (Accession # CAA70124); Cry1Ia6 (Accession # AAC26910); Cry1Ia7 (Accession # AAM73516); Cry1Ia8 (Accession # AAK66742); Cry1Ia9 (Accession # AAQ08616); Cry1Ia10 (Accession # AAP86782); Cry1Ia11 (Accession # CAC85964); Cry1Ia12 (Accession # AAV53390); Cry1Ia13 (Accession # ABF83202); Cry1Ia14 (Accession # ACG63871); Cry1Ia15 (Accession # FJ617445); Cry1Ia16 (Accession # FJ617448); Cry1Ia17 (Accession # GU989199); Cry1Ia18 (Accession # ADK23801); Cry1Ia19 (Accession # HQ439787); Cry1Ia20 (Accession # JQ228426); Cry1Ia21 (Accession # JQ228424); Cry1Ia22 (Accession # JQ228427); Cry1Ia23 (Accession # JQ228428); Cry1Ia24 (Accession # JQ228429); Cry1Ia25 (Accession # JQ228430); Cry1Ia26 (Accession # JQ228431); Cry1Ia27 (Accession # JQ228432); Cry1Ia28 (Accession # JQ228433); Cry1Ia29 (Accession # JQ228434); Cry1Ia30 (Accession # JQ317686); Cry1Ia31 (Accession # JX944038); Cry1Ia32 (Accession # JX944039); Cry1Ia33 (Accession # JX944040); Cry1Ib1 (Accession # AAA82114); Cry1Ib2 (Accession # ABW88019); Cry1Ib3 (Accession # ACD75515); Cry1Ib4 (Accession # HM051227); Cry1Ib5 (Accession # HM070028); Cry1Ib6 (Accession # ADK38579); Cry1Ib7 (Accession # JN571740); Cry1Ib8 (Accession # JN675714); Cry1Ib9 (Accession # JN675715); Cry1Ib10 (Accession # JN675716); Cry1Ib11 (Accession # JQ228423); Cry1Ic1 (Accession # AAC62933); Cry1Ic2 (Accession # AAE71691); Cry1Id1 (Accession # AAD44366); Cry1Id2 (Accession # JQ228422); Cry1Ie1 (Accession # AAG43526); Cry1Ie2 (Accession # HM439636); Cry1Ie3 (Accession # KC156647); Cry1Ie4 (Accession # KC156681); Cry1If1 (Accession # AAQ52382); Cry1Ig1 (Accession # KC156701); Cry1I-like (Accession # AAC31094); Cry1I-like (Accession # ABG88859); Cry1Ja1 (Accession # AAA22341); Cry1Ja2 (Accession # HM070030); Cry1Ja3 (Accession # JQ228425); Cry1Jb1 (Accession # AAA98959); Cry1Jc1 (Accession # AAC31092); Cry1Jc2 (Accession # AAQ52372); Cry1Jd1 (Accession # CAC50779); Cry1Ka1 (Accession # AAB00376); Cry1Ka2 (Accession # HQ439783); Cry1La1 (Accession # AAS60191); Cry1La2 (Accession # HM070031); Cry1Ma1 (Accession # FJ884067); Cry1Ma2 (Accession # KC156659); Cry1Na1 (Accession # KC156648); Cry1Nb1 (Accession # KC156678); Cry1-like (Accession # AAC31091); Cry2Aa1 (Accession # AAA22335); Cry2Aa2 (Accession # AAA83516); Cry2Aa3 (Accession # D86064); Cry2Aa4 (Accession # AAC04867); Cry2Aa5 (Accession # CAA10671); Cry2Aa6 (Accession # CAA10672); Cry2Aa7 (Accession # CAA10670); Cry2Aa8 (Accession # AAO13734); Cry2Aa9 (Accession # AAO13750); Cry2Aa10 (Accession # AAQ04263); Cry2Aa11 (Accession # AAQ52384); Cry2Aa12 (Accession # ABI83671); Cry2Aa13 (Accession # ABL01536); Cry2Aa14 (Accession # ACF04939); Cry2Aa15 (Accession # JN426947); Cry2Ab1 (Accession # AAA22342); Cry2Ab2 (Accession # CAA39075); Cry2Ab3 (Accession # AAG36762); Cry2Ab4 (Accession # AAO13296); Cry2Ab5 (Accession # AAQ04609); Cry2Ab6 (Accession # AAP59457); Cry2Ab7 (Accession # AAZ66347); Cry2Ab8 (Accession # ABC95996); Cry2Ab9 (Accession # ABC74968); Cry2Ab10 (Accession # EF157306); Cry2Ab11 (Accession # CAM84575); Cry2Ab12 (Accession # ABM21764); Cry2Ab13 (Accession # ACG76120); Cry2Ab14 (Accession # ACG76121); Cry2Ab15 (Accession # HM037126); Cry2Ab16 (Accession # GQ866914); Cry2Ab17 (Accession # HQ439789); Cry2Ab18 (Accession # JN135255); Cry2Ab19 (Accession # JN135256); Cry2Ab20 (Accession # JN135257); Cry2Ab21 (Accession # JN135258); Cry2Ab22 (Accession # JN135259); Cry2Ab23 (Accession # JN135260); Cry2Ab24 (Accession # JN135261); Cry2Ab25 (Accession # JN415485); Cry2Ab26 (Accession # JN426946); Cry2Ab27 (Accession # JN415764); Cry2Ab28 (Accession # JN651494); Cry2Ac1 (Accession # CAA40536); Cry2Ac2 (Accession # AAG35410); Cry2Ac3 (Accession # AAQ52385); Cry2Ac4 (Accession # ABC95997); Cry2Ac5 (Accession # ABC74969); Cry2Ac6 (Accession # ABC74793); Cry2Ac7 (Accession # CAL18690); Cry2Ac8 (Accession # CAM09325); Cry2Ac9 (Accession # CAM09326); Cry2Ac10 (Accession # ABN15104); Cry2Ac11 (Accession # CAM83895); Cry2Ac12 (Accession # CAM83896); Cry2Ad1 (Accession # AAF09583); Cry2Ad2 (Accession # ABC86927); Cry2Ad3 (Accession # CAK29504); Cry2Ad4 (Accession # CAM32331); Cry2Ad5 (Accession # CAO78739); Cry2Ae1 (Accession # AAQ52362); Cry2Af1 (Accession # ABO30519); Cry2Af2 (Accession # GQ866915); Cry2Ag1 (Accession # ACH91610); Cry2Ah1 (Accession # EU939453); Cry2Ah2 (Accession # ACL80665); Cry2Ah3 (Accession # GU073380); Cry2Ah4

(Accession # KC156702); Cry2Ai1 (Accession # FJ788388); Cry2Aj (Accession #); Cry2Ak1 (Accession # KC156660); Cry2Ba1 (Accession # KC156658); Cry3Aa1 (Accession # AAA22336); Cry3Aa2 (Accession # AAA22541); Cry3Aa3 (Accession # CAA68482); Cry3Aa4 (Accession # AAA22542); Cry3Aa5 (Accession # AAA50255); Cry3Aa6 (Accession # AAC43266); Cry3Aa7 (Accession # CAB41411); Cry3Aa8 (Accession # AAS79487); Cry3Aa9 (Accession # AAW05659); Cry3Aa10 (Accession # AAU29411); Cry3Aa11 (Accession # AAW82872); Cry3Aa12 (Accession # ABY49136); Cry3Ba1 (Accession # CAA34983); Cry3Ba2 (Accession # CAA00645); Cry3Ba3 (Accession # JQ397327); Cry3Bb1 (Accession # AAA22334); Cry3Bb2 (Accession # AAA74198); Cry3Bb3 (Accession # I15475); Cry3Ca1 (Accession # CAA42469); Cry4Aa1 (Accession # CAA68485); Cry4Aa2 (Accession # BAA00179); Cry4Aa3 (Accession # CAD30148); Cry4Aa4 (Accession # AFB18317); Cry4A-like (Accession # AAY96321); Cry4Ba1 (Accession # CAA30312); Cry4Ba2 (Accession # CAA30114); Cry4Ba3 (Accession # AAA22337); Cry4Ba4 (Accession # BAA00178); Cry4Ba5 (Accession # CAD30095); Cry4Ba-like (Accession # ABC47686); Cry4Ca1 (Accession # EU646202); Cry4Cb1 (Accession # FJ403208); Cry4Cb2 (Accession # FJ597622); Cry4Cc1 (Accession # FJ403207); Cry5Aa1 (Accession # AAA67694); Cry5Ab1 (Accession # AAA67693); Cry5Ac1 (Accession # I34543); Cry5Ad1 (Accession # ABQ82087); Cry5Ba1 (Accession # AAA68598); Cry5Ba2 (Accession # ABW88931); Cry5Ba3 (Accession # AFJ04417); Cry5Ca1 (Accession # HM461869); Cry5Ca2 (Accession # ZP_04123426); Cry5Da1 (Accession # HM461870); Cry5Da2 (Accession # ZP_04123980); Cry5Ea1 (Accession # HM485580); Cry5Ea2 (Accession # ZP_04124038); Cry6Aa1 (Accession # AAA22357); Cry6Aa2 (Accession # AAM46849); Cry6Aa3 (Accession # ABH03377); Cry6Ba1 (Accession # AAA22358); Cry7Aa1 (Accession # AAA22351); Cry7Ab1 (Accession # AAA21120); Cry7Ab2 (Accession # AAA21121); Cry7Ab3 (Accession # ABX24522); Cry7Ab4 (Accession # EU380678); Cry7Ab5 (Accession # ABX79555); Cry7Ab6 (Accession # ACI44005); Cry7Ab7 (Accession # ADB89216); Cry7Ab8 (Accession # GU145299); Cry7Ab9 (Accession # ADD92572); Cry7Ba1 (Accession # ABB70817); Cry7Bb1 (Accession # KC156653); Cry7Ca1 (Accession # ABR67863); Cry7Cb1 (Accession # KC156698); Cry7Da1 (Accession # ACQ99547); Cry7Da2 (Accession # HM572236); Cry7Da3 (Accession # KC156679); Cry7Ea1 (Accession # HM035086); Cry7Ea2 (Accession # HM132124); Cry7Ea3 (Accession # EEM19403); Cry7Fa1 (Accession # HM035088); Cry7Fa2 (Accession # EEM19090); Cry7Fb1 (Accession # HM572235); Cry7Fb2 (Accession # KC156682); Cry7Ga1 (Accession # HM572237); Cry7Ga2 (Accession # KC156669); Cry7Gb1 (Accession # KC156650); Cry7Gc1 (Accession # KC156654); Cry7Gd1 (Accession # KC156697); Cry7Ha1 (Accession # KC156651); Cry7Ia1 (Accession # KC156665); Cry7Ja1 (Accession # KC156671); Cry7Ka1 (Accession # KC156680); Cry7Kb1 (Accession # BAM99306); Cry7La1 (Accession # BAM99307); Cry8Aa1 (Accession # AAA21117); Cry8Ab1 (Accession # EU044830); Cry8Ac1 (Accession # KC156662); Cry8Ad1 (Accession # KC156684); Cry8Ba1 (Accession # AAA21118); Cry8Bb1 (Accession # CAD57542); Cry8Bc1 (Accession # CAD57543); Cry8Ca1 (Accession # AAA21119); Cry8Ca2 (Accession # AAR98783); Cry8Ca3 (Accession # EU625349); Cry8Ca4 (Accession # ADB54826); Cry8Da1 (Accession # BAC07226); Cry8Da2 (Accession # BD133574); Cry8Da3 (Accession # BD133575); Cry8Db1 (Accession # BAF93483); Cry8Ea1 (Accession # AAQ73470); Cry8Ea2 (Accession # EU047597); Cry8Ea3 (Accession # KC855216); Cry8Fa1 (Accession # AAT48690); Cry8Fa2 (Accession # HQ174208); Cry8Fa3 (Accession # AFH78109); Cry8Ga1 (Accession # AAT46073); Cry8Ga2 (Accession # ABC42043); Cry8Ga3 (Accession # FJ198072); Cry8Ha1 (Accession # AAW81032); Cry8Ia1 (Accession # EU381044); Cry8Ia2 (Accession # GU073381); Cry8Ia3 (Accession # HM044664); Cry8Ia4 (Accession # KC156674); Cry8Ib1 (Accession # GU325772); Cry8Ib2 (Accession # KC156677); Cry8Ja1 (Accession # EU625348); Cry8Ka1 (Accession # FJ422558); Cry8Ka2 (Accession # ACN87262); Cry8Kb1 (Accession # HM123758); Cry8Kb2 (Accession # KC156675); Cry8La1 (Accession # GU325771); Cry8Ma1 (Accession # HM044665); Cry8Ma2 (Accession # EEM86551); Cry8Ma3 (Accession # HM210574); Cry8Na1 (Accession # HM640939); Cry8Pa1 (Accession # HQ388415); Cry8Qa1 (Accession # HQ441166); Cry8Qa2 (Accession # KC152468); Cry8Ra1 (Accession # AFP87548); Cry8Sa1 (Accession # JQ740599); Cry8Ta1 (Accession # KC156673); Cry8-like (Accession # FJ770571); Cry8-like (Accession # ABS53003); Cry9Aa1 (Accession # CAA41122); Cry9Aa2 (Accession # CAA41425); Cry9Aa3 (Accession # GQ249293); Cry9Aa4 (Accession # GQ249294); Cry9Aa5 (Accession # JX174110); Cry9Aa like (Accession # AAQ52376); Cry9Ba1 (Accession # CAA52927); Cry9Ba2 (Accession # GU299522); Cry9Bb1 (Accession # AAV28716); Cry9Ca1 (Accession # CAA85764); Cry9Ca2 (Accession # AAQ52375); Cry9Da1 (Accession # BAA19948); Cry9Da2 (Accession # AAB97923); Cry9Da3 (Accession # GQ249293); Cry9Da4 (Accession # GQ249297); Cry9Db1 (Accession # AAX78439); Cry9Dc1 (Accession # KC156683); Cry9Ea1 (Accession # BAA34908); Cry9Ea2 (Accession # AAO12908); Cry9Ea3 (Accession # ABM21765); Cry9Ea4 (Accession # ACE88267); Cry9Ea5 (Accession # ACF04743); Cry9Ea6 (Accession # ACG63872); Cry9Ea7 (Accession # FJ380927); Cry9Ea8 (Accession # GQ249292); Cry9Ea9 (Accession # JN651495); Cry9Eb1 (Accession # CAC50780); Cry9Eb2 (Accession # GQ249298); Cry9Eb3 (Accession # KC156646); Cry9Ec1 (Accession # AAC63366); Cry9Ed1 (Accession # AAX78440); Cry9Ee1 (Accession # GQ249296); Cry9Ee2 (Accession # KC156664); Cry9Fa1 (Accession # KC156692); Cry9Ga1 (Accession # KC156699); Cry9-like (Accession # AAC63366); Cry10Aa1 (Accession # AAA22614); Cry10Aa2 (Accession # E00614); Cry10Aa3 (Accession # CAD30098); Cry10Aa4 (Accession # AFB18318); Cry10A-like (Accession # DQ167578); Cry11Aa1 (Accession # AAA22352); Cry11Aa2 (Accession # AAA22611); Cry11Aa3 (Accession # CAD30081); Cry11Aa4 (Accession # AFB18319); Cry11Aa-like (Accession # DQ166531); Cry11Ba1 (Accession # CAA60504); Cry11Bb1 (Accession # AAC97162); Cry11Bb2 (Accession # HM068615); Cry12Aa1 (Accession # AAA22355); Cry13Aa1 (Accession # AAA22356); Cry14Aa1 (Accession # AAA21516); Cry14Ab1 (Accession # KC156652); Cry15Aa1 (Accession # AAA22333); Cry16Aa1 (Accession # CAA63860); Cry17Aa1 (Accession # CAA67841); Cry18Aa1 (Accession # CAA67506); Cry18Ba1 (Accession # AAF89667); Cry18Ca1 (Accession # AAF89668); Cry19Aa1 (Accession # CAA68875); Cry19Ba1 (Accession # BAA32397); Cry19Ca1 (Accession

AFM37572); Cry20Aa1 (Accession # AAB93476); Cry20Ba1 (Accession # ACS93601); Cry20Ba2 (Accession # KC156694); Cry20-like (Accession # GQ144333); Cry21Aa1 (Accession # I32932); Cry21Aa2 (Accession # I66477); Cry21Ba1 (Accession # BAC06484); Cry21Ca1 (Accession # JF521577); Cry21Ca2 (Accession # KC156687); Cry21Da1 (Accession # JF521578); Cry22Aa1 (Accession # I34547); Cry22Aa2 (Accession # CAD43579); Cry22Aa3 (Accession # ACD93211); Cry22Ab1 (Accession # AAK50456); Cry22Ab2 (Accession # CAD43577); Cry22Ba1 (Accession # CAD43578); Cry22Bb1 (Accession # KC156672); Cry23Aa1 (Accession # AAF76375); Cry24Aa1 (Accession # AAC61891); Cry24Ba1 (Accession # BAD32657); Cry24Ca1 (Accession # CAJ43600); Cry25Aa1 (Accession # AAC61892); Cry26Aa1 (Accession # AAD25075); Cry27Aa1 (Accession # BAA82796); Cry28Aa1 (Accession # AAD24189); Cry28Aa2 (Accession # AAG00235); Cry29Aa1 (Accession # CAC80985); Cry30Aa1 (Accession # CAC80986); Cry30Ba1 (Accession # BAD00052); Cry30Ca1 (Accession # BAD67157); Cry30Ca2 (Accession # ACU24781); Cry30Da1 (Accession # EF095955); Cry30Db1 (Accession # BAE80088); Cry30Ea1 (Accession # ACC95445); Cry30Ea2 (Accession # FJ499389); Cry30Fa1 (Accession # ACI22625); Cry30Ga1 (Accession # ACG60020); Cry30Ga2 (Accession # HQ638217); Cry31Aa1 (Accession # BAB11757); Cry31Aa2 (Accession # AAL87458); Cry31Aa3 (Accession # BAE79808); Cry31Aa4 (Accession # BAF32571); Cry31Aa5 (Accession # BAF32572); Cry31Aa6 (Accession # BA144026); Cry31Ab1 (Accession # BAE79809); Cry31Ab2 (Accession # BAF32570); Cry31Ac1 (Accession # BAF34368); Cry31Ac2 (Accession # AB731600); Cry31Ad1 (Accession # BA144022); Cry32Aa1 (Accession # AAG36711); Cry32Aa2 (Accession # GU063849); Cry32Ab1 (Accession # GU063850); Cry32Ba1 (Accession # BAB78601); Cry32Ca1 (Accession # BAB78602); Cry32Cb1 (Accession # KC156708); Cry32Da1 (Accession # BAB78603); Cry32Ea1 (Accession # GU324274); Cry32Ea2 (Accession # KC156686); Cry32Eb1 (Accession # KC156663); Cry32Fa1 (Accession # KC156656); Cry32Ga1 (Accession # KC156657); Cry32Ha1 (Accession # KC156661); Cry32Hb1 (Accession # KC156666); Cry32Ia1 (Accession # KC156667); Cry32Ja1 (Accession # KC156685); Cry32Ka1 (Accession # KC156688); Cry32La1 (Accession # KC156689); Cry32Ma1 (Accession # KC156690); Cry32Mb1 (Accession # KC156704); Cry32Na1 (Accession # KC156691); Cry32Oa1 (Accession # KC156703); Cry32Pa1 (Accession # KC156705); Cry32Qa1 (Accession # KC156706); Cry32Ra1 (Accession # KC156707); Cry32Sa1 (Accession # KC156709); Cry32Ta1 (Accession # KC156710); Cry32Ua1 (Accession # KC156655); Cry33Aa1 (Accession # AAL26871); Cry34Aa1 (Accession # AAG50341); Cry34Aa2 (Accession # AAK64560); Cry34Aa3 (Accession # AAT29032); Cry34Aa4 (Accession # AAT29030); Cry34Ab1 (Accession # AAG41671); Cry34Ac1 (Accession # AAG50118); Cry34Ac2 (Accession # AAK64562); Cry34Ac3 (Accession # AAT29029); Cry34Ba1 (Accession # AAK64565); Cry34Ba2 (Accession # AAT29033); Cry34Ba3 (Accession # AAT29031); Cry35Aa1 (Accession # AAG50342); Cry35Aa2 (Accession # AAK64561); Cry35Aa3 (Accession # AAT29028); Cry35Aa4 (Accession # AAT29025); Cry35Ab1 (Accession # AAG41672); Cry35Ab2 (Accession # AAK64563); Cry35Ab3 (Accession # AY536891); Cry35Ac1 (Accession # AAG50117); Cry35Ba1 (Accession # AAK64566); Cry35Ba2 (Accession # AAT29027); Cry35Ba3 (Accession # AAT29026); Cry36Aa1 (Accession # AAK64558); Cry37Aa1 (Accession # AAF76376); Cry38Aa1 (Accession # AAK64559); Cry39Aa1 (Accession # BAB72016); Cry40Aa1 (Accession # BAB72018); Cry40Ba1 (Accession # BAC77648); Cry40Ca1 (Accession # EU381045); Cry40Da1 (Accession # ACF15199); Cry41Aa1 (Accession # BAD35157); Cry41Ab1 (Accession # BAD35163); Cry41Ba1 (Accession # HM461871); Cry41Ba2 (Accession # ZP_04099652); Cry42Aa1 (Accession # BAD35166); Cry43Aa1 (Accession # BAD15301); Cry43Aa2 (Accession # BAD95474); Cry43Ba1 (Accession # BAD15303); Cry43Ca1 (Accession # KC156676); Cry43Cb1 (Accession # KC156695); Cry43Cc1 (Accession # KC156696); Cry43-like (Accession # BAD15305); Cry44Aa (Accession # BAD08532); Cry45Aa (Accession # BAD22577); Cry46Aa (Accession # BAC79010); Cry46Aa2 (Accession # BAG68906); Cry46Ab (Accession # BAD35170); Cry47Aa (Accession # AAY24695); Cry48Aa (Accession # CAJ18351); Cry48Aa2 (Accession # CAJ86545); Cry48Aa3 (Accession # CAJ86546); Cry48Ab (Accession # CAJ86548); Cry48Ab2 (Accession # CAJ86549); Cry49Aa (Accession # CAH56541); Cry49Aa2 (Accession # CAJ86541); Cry49Aa3 (Accession # CAJ86543); Cry49Aa4 (Accession # CAJ86544); Cry49Ab1 (Accession # CAJ86542); Cry50Aa1 (Accession # BAE86999); Cry50Ba1 (Accession # GU446675); Cry50Ba2 (Accession # GU446676); Cry51Aa1 (Accession # ABI14444); Cry51Aa2 (Accession # GU570697); Cry52Aa1 (Accession # EF613489); Cry52Ba1 (Accession # FJ361760); Cry53Aa1 (Accession # EF633476); Cry53Ab1 (Accession # FJ361759); Cry54Aa1 (Accession # ACA52194); Cry54Aa2 (Accession # GQ140349); Cry54Ba1 (Accession # GU446677); Cry55Aa1 (Accession # ABW88932); Cry54Ab1 (Accession # JQ916908); Cry55Aa2 (Accession # AAE33526); Cry56Aa1 (Accession # ACU57499); Cry56Aa2 (Accession # GQ483512); Cry56Aa3 (Accession # JX025567); Cry57Aa1 (Accession # ANC87261); Cry58Aa1 (Accession # ANC87260); Cry59Ba1 (Accession # JN790647); Cry59Aa1 (Accession # ACR43758); Cry60Aa1 (Accession # ACU24782); Cry60Aa2 (Accession # EAO57254); Cry60Aa3 (Accession # EEM99278); Cry60Ba1 (Accession # GU810818); Cry60Ba2 (Accession # EAO57253); Cry60Ba3 (Accession # EEM99279); Cry61Aa1 (Accession # HM035087); Cry61Aa2 (Accession # HM132125); Cry61Aa3 (Accession # EEM19308); Cry62Aa1 (Accession # HM054509); Cry63Aa1 (Accession # BA144028); Cry64Aa1 (Accession # BAJ05397); Cry65Aa1 (Accession # HM461868); Cry65Aa2 (Accession # ZP_04123838); Cry66Aa1 (Accession # HM485581); Cry66Aa2 (Accession # ZP_04099945); Cry67Aa1 (Accession # HM485582); Cry67Aa2 (Accession # ZP_04148882); Cry68Aa1 (Accession # HQ113114); Cry69Aa1 (Accession # HQ401006); Cry69Aa2 (Accession # JQ821388); Cry69Ab1 (Accession # JN209957); Cry70Aa1 (Accession # JN646781); Cry70Ba1 (Accession # ADO51070); Cry70Bb1 (Accession # EEL67276); Cry71Aa1 (Accession # JX025568); Cry72Aa1 (Accession # JX025569).

Examples of δ-endotoxins also include but are not limited to Cry1A proteins of U.S. Pat. Nos. 5,880,275 and 7,858,849; a DIG-3 or DIG-11 toxin (N-terminal deletion of α-helix 1 and/or α-helix 2 variants of Cry proteins such as Cry1A) of U.S. Pat. Nos. 8,304,604 and 8,304,605, Cry1B of U.S. patent application Ser. No. 10/525,318; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Numbers 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry 51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US20090144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US 2010/0005543; and Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/which can be accessed on the world-wide web using the "www" prefix). The insecticidal activity of Cry proteins is well known to one skilled in the art (for review, see, van Frannkenhuyzen, (2009) J. Invert. Path. 101:1-16). The use of Cry proteins as transgenic plant traits is well known to one skilled in the art and Cry-transgenic plants including but not limited to Cry1Ac, Cry1Ac+ Cry2Ab, Cry1Ab, Cry1A.105, Cry1F, Cry1Fa2, Cry1F+ Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716,820; 5,792,931; 5,798,255; 5,846,812; 6,083,736; 6,538,177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876 B1; 6,040,497; 5,804,425; 5,633,435; 5,145,783; 4,971,908; 5,312,910; 5,188,642; 5,094,945, 4,940,835; 5,866,775; 6,225,114 B1; 6,130,366; 5,310,667; 4,535,060; 4,769,061; 5,633,448; 5,510,471; Re. 36,449; RE 37,287 E and 5,491,288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al.; De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616 B1 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-52 and Acc1-53 genes described by Marshall, et al., (1992) *Theor. Appl. Genet.* 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) Plant Cell 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306 B1; 6,282,837 B1 and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, various Ipa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. Nos. 6,197,561, 6,291,224, 6,391, 348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that confers male fertility to be transcribed.

(A) Introduction of a deacetylase gene under the control of a tapetum-specific promoter and with the application of the chemical N-Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859, 341; 6,297,426; 5,478,369; 5,824,524; 5,850,014 and 6,265, 640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., 1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417, 428, 6,664,446, 6,706,866, 6,717,034, 6,801,104, WO 2000/ 060089, WO 2001/026459, WO 2001/035725, WO 2001/ 034726, WO 2001/035727, WO 2001/036444, WO 2001/ 036597, WO 2001/036598, WO 2002/015675, WO 2002/ 017430, WO 2002/077185, WO 2002/079403, WO 2003/ 013227, WO 2003/013228, WO 2003/014327, WO 2004/ 031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/ 0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. Nos. 6,177, 275 and 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/ 14414 (CON), WO 1996/38560, WO 2001/21822 (VRN1), WO 2000/44918 (VRN2), WO 1999/49064 (GI), WO 2000/ 46358 (FR1), WO 1997/29123, U.S. Pat. Nos. 6,794,560, 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events in Table 6A-6F.

TABLE 6A

*Triticum aestivum* Wheat

| Event | Company | Description |
|---|---|---|
| AP205CL | BASF Inc. | Selection for a mutagenized version of the enzyme acetohydroxyacid synthase (AHAS), also known as acetolactate synthase (ALS) or acetolactate pyruvate-lyase. |
| AP602CL | BASF Inc. | Selection for a mutagenized version of the enzyme acetohydroxyacid synthase (AHAS), also known as acetolactate synthase (ALS) or acetolactate pyruvate-lyase. |
| BW255-2, BW238-3 | BASF Inc. | Selection for a mutagenized version of the enzyme acetohydroxyacid synthase (AHAS), also known as acetolactate synthase (ALS) or acetolactate pyruvate-lyase. |
| BW7 | BASF Inc. | Tolerance to imidazolinone herbicides induced by chemical mutagenesis of the acetohydroxyacid synthase (AHAS) gene using sodium azide. |
| MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. |

TABLE 6A-continued

*Triticum aestivum* Wheat

| Event | Company | Description |
|---|---|---|
| SWP965001 | Cyanamid Crop Protection | Selection for a mutagenized version of the enzyme acetohydroxyacid synthase (AHAS), also known as acetolactate synthase (ALS) or acetolactate pyruvate-lyase. |
| Teal 11A | BASF Inc. | Selection for a mutagenized version of the enzyme acetohydroxyacid synthase (AHAS), also known as acetolactate synthase (ALS) or acetolactate pyruvate-lyase. |

TABLE 6B

*Helianthus annuus* Sunflower

| Event | Company | Description |
|---|---|---|
| X81359 | BASF Inc. | Tolerance to imidazolinone herbicides by selection of a naturally occurring mutant. |

TABLE 6C

*Glycine max* L. Soybean

| Event | Company | Description |
|---|---|---|
| A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| A5547-127 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). |
| DP-305423 | Pioneer Hi-Bred International Inc. | High oleic acid soybean produced by inserting additional copies of a portion of the omega-6 desaturase encoding gene, gm-fad2-1 resulting in silencing of the endogenous omega-6 desaturase gene (FAD2-1). |
| DP356043 | Pioneer Hi-Bred International Inc. | Soybean event with two herbicide tolerance genes: glyphosate N-acetyltransferase, which detoxifies glyphosate, and a modified acetolactate synthase (ALS) gene which is tolerant to ALS-inhibiting herbicides. |
| G94-1, G94-19, G168 | DuPont Canada Agricultural Products | High oleic acid soybean produced by inserting a second copy of the fatty acid desaturase (GmFad2-1) encoding gene from soybean, which resulted in "silencing" of the endogenous host gene. |
| GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. |

TABLE 6C-continued

*Glycine max* L. Soybean

| Event | Company | Description |
|---|---|---|
| GU262 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. |
| MON87701 | Monsanto Company | Resistance to Lepidopteran pests of soybean including velvetbean caterpillar (*Anticarsia gemmatalis*) and soybean looper (*Pseudoplusia includens*). |
| MON87701 × MON89788 | Monsanto Company | Glyphosate herbicide tolerance through expression of the EPSPS encoding gene from *A. tumefaciens* strain CP4, and resistance to Lepidopteran pests of soybean including velvetbean caterpillar (*Anticarsia gemmatalis*) and soybean looper (*Pseudoplusia includens*) via expression of the Cry1Ac encoding gene from *B. thuringiensis*. |
| MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. |
| OT96-15 | Agri-culture & Agri-Food Canada | Low linolenic acid soybean produced through traditional cross-breeding to incorporate the novel trait from a naturally occurring fan1 gene mutant that was selected for low linolenic acid. |
| W62, W98 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces hygroscopicus*. |

TABLE 6D

*Medicago sativa* Alfalfa

| Event | Company | Description |
|---|---|---|
| J101, J163 | Monsanto Company and Forage Genetics International | Glyphosate herbicide tolerant alfalfa (lucerne) produced by inserting a gene encoding the enzyme 5-enolypyruvylshikimate-3-phosphate synthase (EPSPS) from the CP4 strain of *Agrobacterium tumefaciens*. |

TABLE 6E

*Oryza sativa* Rice

| Event | Company | Description |
|---|---|---|
| CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). |
| IMINTA-1, IMINTA-4 | BASF Inc. | Tolerance to imidazolinone herbicides induced by chemical mutagenesis of the acetolactate synthase (ALS) enzyme using sodium azide. |
| LLRICE06, LLRICE62 | Aventis Crop-Science | Glufosinate ammonium herbicide tolerant rice produced by inserting a modified phosphinothricin acetyltransferase (PAT) encoding gene from the soil bacterium *Streptomyces hygroscopicus*). |
| LLRICE601 | Bayer Crop-Science (Aventis Crop-Science (AgrEvo)) | Glufosinate ammonium herbicide tolerant rice produced by inserting a modified phosphinothricin acetyltransferase (PAT) encoding gene from the soil bacterium *Streptomyces hygroscopicus*). |
| PWC16 | BASF Inc. | Tolerance to the imidazolinone herbicide, imazethapyr, induced by chemical mutagenesis of the acetolactate synthase (ALS) enzyme using ethyl methanesulfonate (EMS). |

TABLE 6F

*Zea mays* L. Maize

| Event | Company | Description |
|---|---|---|
| 176 | Syngenta Seeds, Inc. | Insect-resistant maize produced by inserting the Cry1Ab gene from *Bacillus thuringiensis* subsp. *kurstaki*. The genetic modification affords resistance to attack by the European corn borer (ECB). |
| 3751IR | Pioneer Hi-Bred International Inc. | Selection of somaclonal variants by culture of embryos on imidazolinone containing media. |
| 676, 678, 680 | Pioneer Hi-Bred International Inc. | Male-sterile and glufosinate ammonium herbicide tolerant maize produced by inserting genes encoding DNA adenine methylase and phosphinothricin acetyltransferase (PAT) from *Escherichia coli* and *Streptomyces viridochromogenes*, respectively. |
| B16 (DLL25) | Dekalb Genetics Corporation | Glufosinate ammonium herbicide tolerant maize produced by inserting the gene encoding phosphinothricin acetyltransferase (PAT) from *Streptomyces hygroscopicus*. |
| BT11 (X4334CBR, X4734CBR) | Syngenta Seeds, Inc. | Insect-resistant and herbicide tolerant maize produced by inserting the Cry1Ab gene from *Bacillus thuringiensis* subsp. *kurstaki*, and the phosphinothricin N-acetyltransferase (PAT) encoding gene from *S. viridochromogenes*. |
| BT11 × GA21 | Syngenta Seeds, Inc. | Stacked insect resistant and herbicide tolerant maize produced by conventional cross breeding of parental lines BT11 (OECD unique identifier: SYN-BTO11-1) and GA21 (OECD unique identifier: MON-OO021-9). |
| BT11 × MIR162 × MIR604 × GA21 | Syngenta Seeds, Inc. | Resistance to Coleopteran pests, particularly corn rootworm pests (*Diabrotica* spp.) and several Lepidopteran pests of corn, including European corn borer (ECB, *Ostrinia nubilalis*), corn earworm (CEW, *Helicoverpa zea*), fall army worm (FAW, *Spodoptera frugiperda*), and black cutworm (BCW, *Agrotis ipsilon*); tolerance to glyphosate and glufosinate-ammonium containing herbicides. |
| BT11 × MIR162 | Syngenta Seeds, Inc. | Stacked insect resistant and herbicide tolerant maize produced by conventional cross breeding of parental lines BT11 (OECD unique identifier: SYN-BTO11-1) |

TABLE 6F-continued

Zea mays L. Maize

| Event | Company | Description |
|---|---|---|
| | | and MIR162 (OECD unique identifier: SYN-IR162-4). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Resistance to other Lepidopteran pests, including *H. zea*, *S. frugiperda*, *A. ipsilon*, and *S. albicosta*, is derived from MIR162, which contains the vip3Aa gene from *Bacillus thuringiensis* strain AB88. |
| BT11 × MIR162 × MIR604 | Syngenta Seeds, Inc. | *Bacillus thuringiensis* Cry1Ab delta-endotoxin protein and the genetic material necessary for its production (via elements of vector pZO1502) in Event Bt11 corn (OECD Unique Identifier: SYN-BTO11-1) × *Bacillus thuringiensis* Vip3Aa20 insecticidal protein and the genetic material necessary for its production (via elements of vector pNOV1300) in Event MIR162 maize (OECD Unique Identifier: SYN-IR162-4) × modified Cry3A protein and the genetic material necessary for its production (via elements of vector pZM26) in Event MIR604 corn (OECD Unique Identifier: SYN-IR604-5). |
| CBH-351 | Aventis Crop-Science | Insect-resistant and glufosinate ammonium herbicide tolerant maize developed by inserting genes encoding Cry9C protein from *Bacillus thuringiensis* subsp *tolworthi* and phosphinothricin acetyltransferase (PAT) from *Streptomyces hygroscopicus*. |
| DAS-06275-8 | DOW Agro-Sciences LLC | Lepidopteran insect resistant and glufosinate ammonium herbicide-tolerant maize variety produced by inserting the Cry1F gene from *Bacillus thuringiensis* var *aizawai* and the phosphinothricin acetyltransferase (PAT) from *Streptomyces hygroscopicus*. |
| BT11 × MIR604 | Syngenta Seeds, Inc. | Stacked insect resistant and herbicide tolerant maize produced by conventional cross breeding of parental lines BT11 (OECD unique identifier: SYN-BTO11-1) and MIR604 (OECD unique identifier: SYN-IR604-5). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. |
| BT11 × MIR604 × GA21 | Syngenta Seeds, Inc. | Stacked insect resistant and herbicide tolerant maize produced by conventional cross breeding of parental lines BT11 (OECD unique identifier: SYN-BTO11-1), MIR604 (OECD unique identifier: SYN-IR604-5) and GA21 (OECD unique identifier: MON-OOO21-9). Resistance to the European Corn Borer and tolerance to the herbicide glufosinate ammonium (Liberty) is derived from BT11, which contains the Cry1Ab gene from *Bacillus thuringiensis* subsp. *kurstaki*, and the phosphinothricin N-acetyltransferase (PAT) encoding gene from *S. viridochromogenes*. Corn rootworm-resistance is derived from MIR604 which contains the mCry3A gene from *Bacillus thuringiensis*. Tolerance to glyphosate herbicide is derived from GA21 which contains a a modified EPSPS gene from maize. |
| DAS-59122-7 | DOW Agro-Sciences LLC and Pioneer Hi-Bred International Inc. | Corn rootworm-resistant maize produced by inserting the Cry34Ab1 and Cry35Ab1 genes from *Bacillus thuringiensis* strain PS149B1. The PAT encoding gene from *Streptomyces viridochromogenes* was introduced as a selectable marker. |
| DAS-59122-7 × TC1507 × NK603 | DOW Agro-Sciences LLC and Pioneer Hi-Bred International Inc. | Stacked insect resistant and herbicide tolerant maize produced by conventional cross breeding of parental lines DAS-59122-7 (OECD unique identifier: DAS-59122-7) and TC1507 (OECD unique identifier: DAS-O15O7-1) with NK603 (OECD unique identifier: MON-OO6O3-6). Corn rootworm-resistance is derived from DAS-59122-7 which contains the Cry34Ab1 and Cry35Ab1 genes from *Bacillus thuringiensis* strain PS149B1. Lepidopteran resistance and tolerance to glufosinate ammonium herbicide is derived from TC1507. Tolerance to glyphosate herbicide is derived from NK603. |
| DBT418 | Dekalb Genetics Corporation | Insect-resistant and glufosinate ammonium herbicide tolerant maize developed by inserting genes encoding Cry1AC protein from *Bacillus thuringiensis* subsp *kurstaki* and phosphinothricin acetyltransferase (PAT) from *Streptomyces hygroscopicus* |
| MIR604 × GA21 | Syngenta Seeds, Inc. | Stacked insect resistant and herbicide tolerant maize produced by conventional cross breeding of parental lines MIR604 (OECD unique identifier: SYN-IR605-5) and GA21 (OECD unique identifier: MON-OOO21-9). Corn rootworm-resistance is derived from MIR604 which contains the mCry3A gene from *Bacillus thuringiensis*. Tolerance to glyphosate herbicide is derived from GA21. |
| MON80100 | Monsanto Company | Insect-resistant maize produced by inserting the Cry1Ab gene from *Bacillus thuringiensis* subsp. *kurstaki*. The genetic modification affords resistance to attack by the European corn borer (ECB). |
| MON802 | Monsanto Company | Insect-resistant and glyphosate herbicide tolerant maize produced by inserting the genes encoding the Cry1Ab protein from *Bacillus thuringiensis* and the 5-enolpyruvylshikimate-3-phosphate synthase (EPSPS) from *A. tumefaciens* strain CP4. |
| MON809 | Pioneer Hi-Bred International Inc. | Resistance to European corn borer (*Ostrinia nubilalis*) by introduction of a synthetic Cry1Ab gene. Glyphosate resistance via introduction of the bacterial version of a plant enzyme, 5-enolpyruvyl shikimate-3-phosphate synthase (EPSPS). |
| MON810 | Monsanto Company | Insect-resistant maize produced by inserting a truncated form of the Cry1Ab gene from *Bacillus thuringiensis* subsp. *kurstaki* HD-1. The genetic |

TABLE 6F-continued

Zea mays L. Maize

| Event | Company | Description |
|---|---|---|
| | | modification affords resistance to attack by the European corn borer (ECB). |
| MON810 × LY038 | Monsanto Company | Stacked insect resistant and enhanced lysine content maize derived from conventional cross-breeding of the parental lines MON810 (OECD identifier: MON-OO81O-6) and LY038 (OECD identifier: REN-OOO38-3). |
| MON810 × MON88017 | Monsanto Company | Stacked insect resistant and glyphosate tolerant maize derived from conventional cross-breeding of the parental lines MON810 (OECD identifier: MON-OO81O-6) and MON88017 (OECD identifier: MON-88O17-3). European corn borer (ECB) resistance is derived from a truncated form of the Cry1Ab gene from *Bacillus thuringiensis* subsp. *kurstaki* HD-1 present in MON810. Corn rootworm resistance is derived from the Cry3Bb1 gene from *Bacillus thuringiensis* subspecies *kumamotoensis* strain EG4691 present in MON88017. Glyphosate tolerance is derived from a 5-enolpyruvylshikimate-3-phosphate synthase (EPSPS) encoding gene from *Agrobacterium tumefaciens* strain CP4 present in MON88017. |
| MON832 | Monsanto Company | Introduction, by particle bombardment, of glyphosate oxidase (GOX) and a modified 5-enolpyruvyl shikimate-3-phosphate synthase (EPSPS), an enzyme involved in the shikimate biochemical pathway for the production of the aromatic amino acids. |
| MON863 | Monsanto Company | Corn rootworm resistant maize produced by inserting the Cry3Bb1 gene from *Bacillus thuringiensis* subsp. *kumamotoensis*. |
| MON863 × MON810 | Monsanto Company | Stacked insect resistant corn hybrid derived from conventional cross-breeding of the parental lines MON863 (OECD identifier: MON-OO863-5) and MON810 (OECD identifier: MON-OO81O-6) |
| MON863 × MON810 × NK603 | Monsanto Company | Stacked insect resistant and herbicide tolerant corn hybrid derived from conventional cross-breeding of the stacked hybrid MON-OO863-5 × MON-OO81O-6 and NK603 (OECD identifier: MON-OO6O3-6). |
| MON863 × NK603 | Monsanto Company | Stacked insect resistant and herbicide tolerant corn hybrid derived from conventional cross-breeding of the parental lines MON863 (OECD identifier: MON-OO863-5) and NK603 (OECD identifier: MON-OO6O3-6). |
| MON87460 | Monsanto Company | MON 87460 was developed to provide reduced yield loss under water-limited conditions compared to conventional maize. Efficacy in MON 87460 is derived by expression of the inserted *Bacillus subtilis* cold shock protein B (CspB). |
| MON88017 | Monsanto Company | Corn rootworm-resistant maize produced by inserting the Cry3Bb1 gene from *Bacillus thuringiensis* subspecies *kumamotoensis* strain EG4691. Glyphosate tolerance derived by inserting a 5-enolpyruvylshikimate-3-phosphate synthase (EPSPS) encoding gene from *Agrobacterium tumefaciens* strain CP4. |
| MON89034 | Monsanto Company | Maize event expressing two different insecticidal proteins from *Bacillus thuringiensis* providing resistance to number of Lepidopteran pests. |
| MON89034 × MON88017 | Monsanto Company | Stacked insect resistant and glyphosate tolerant maize derived from conventional cross-breeding of the parental lines MON89034 (OECD identifier: MON-89O34-3) and MON88017 (OECD identifier: MON-88O17-3). Resistance to Lepidopteran insects is derived from two Cry genes present in MON89043. Corn rootworm resistance is derived from a single Cry genes and glyphosate tolerance is derived from the 5-enolpyruvylshikimate-3-phosphate synthase (EPSPS) encoding gene from *Agrobacterium tumefaciens* present in MON88017. |
| MON89034 × NK603 | Monsanto Company | Stacked insect resistant and herbicide tolerant maize produced by conventional cross breeding of parental lines MON89034 (OECD identifier: MON-89O34-3) with NK603 (OECD unique identifier: MON-OO6O3-6). Resistance to Lepidopteran insects is derived from two Cry genes present in MON89043. Tolerance to glyphosate herbicide is derived from NK603. |
| NK603 × MON810 | Monsanto Company | Stacked insect resistant and herbicide tolerant corn hybrid derived from conventional cross-breeding of the parental lines NK603 (OECD identifier: MON-OO6O3-6) and MON810 (OECD identifier: MON-OO81O-6). |
| MON89034 × TC1507 × MON88017 × DAS-59122-7 | Monsanto Company and Mycogen Seeds c/o Dow Agro-Sciences LLC | Stacked insect resistant and herbicide tolerant maize produced by conventional cross breeding of parental lines: MON89034, TC1507, MON88017, and DAS-59122. Resistance to the above-ground and below-ground insect pests and tolerance to glyphosate and glufosinate-ammonium containing herbicides. |
| MS3 | Bayer Crop-Science (Aventis Crop-Science (AgrEvo)) | Male sterility caused by expression of the barnase ribonuclease gene from *Bacillus amyloliquefaciens*; PPT resistance was via PPT-acetyltransferase (PAT). |
| MS6 | Bayer Crop-Science (Aventis Crop-Science (AgrEvo)) | Male sterility caused by expression of the barnase ribonuclease gene from *Bacillus amyloliquefaciens*; PPT resistance was via PPT-acetyltransferase (PAT). |
| NK603 | Monsanto Company | Introduction, by particle bombardment, of a modified 5-enolpyruvyl shikimate-3-phosphate synthase (EPSPS), an enzyme involved in the shikimate biochemical pathway for the production of the aromatic amino acids. |
| NK603 × T25 | Monsanto Company | Stacked glufosinate ammonium and glyphosate herbicide tolerant maize hybrid derived from conventional cross-breeding of the parental lines NK603 (OECD identifier: MON-OO6O3-6) and T25 (OECD identifier: ACS-ZM003-2). |
| T25 × MON810 | Bayer Crop-Science (Aventis Crop-Science (AgrEvo)) | Stacked insect resistant and herbicide tolerant corn hybrid derived from conventional cross-breeding of the parental lines T25 (OECD identifier: ACS-ZMOO3-2) and MON810 (OECD identifier: MON-OO81O-6). |

TABLE 6F-continued

Zea mays L. Maize

| Event | Company | Description |
|---|---|---|
| TC1507 | Mycogen (c/o Dow Agro-Sciences); Pioneer (c/o DuPont) | Insect-resistant and glufosinate ammonium herbicide tolerant maize produced by inserting the Cry1F gene from Bacillus thuringiensis var. aizawai and the phosphinothricin N-acetyltransferase encoding gene from Streptomyces viridochromogenes. |
| TC1507 × NK603 | DOW Agro-Sciences LLC | Stacked insect resistant and herbicide tolerant corn hybrid derived from conventional cross-breeding of the parental lines 1507 (OECD identifier: DAS-O15O7-1) and NK603 (OECD identifier: MON-OO6O3-6). |
| TC1507 × DAS-59122-7 | DOW Agro-Sciences LLC and Pioneer Hi-Bred International Inc. | Stacked insect resistant and herbicide tolerant maize produced by conventional cross breeding of parental lines TC1507 (OECD unique identifier: DAS-O15O7-1) with DAS-59122-7 (OECD unique identifier: DAS-59122-7). Resistance to Lepidopteran insects is derived from TC1507 due the presence of the Cry1F gene from Bacillus thuringiensis var. aizawai. Corn rootworm-resistance is derived from DAS-59122-7 which contains the Cry34Ab1 and Cry35Ab1 genes from Bacillus thuringiensis strain PS149B1. Tolerance to glufosinate ammonium herbicide is derived from TC1507 from the phosphinothricin N-acetyltransferase encoding gene from Streptomyces viridochromogenes. |

Other events with regulatory approval are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more polynucleotide encoding the polypeptides of the PtIP-50 polypeptide or the PtIP-65 polypeptide or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment (U.S. Pat. No. 5,107,065). The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) Plant J. 16:651-659 and Gura, (2000) Nature 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) Nature 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) Trends Genet. 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) Nature 409:363). Short interfering RNAs derived from dicer activity are typically about 21 to about 23 nucleotides in length and comprise about 19 base pair duplexes (Elbashir, et al., (2001) Genes Dev. 15:188). Dicer has also been implicated in the excision of 21- and 22-nucleotide small temporal RNAs (stRNAs) from precursor RNA of conserved structure that are implicated in translational control (Hutvagner, et al., (2001) Science 293: 834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) Genes Dev. 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) Science 297:1818-1819; Volpe, et al., (2002) Science 297: 1833-1837; Jenuwein, (2002) Science 297:2215-2218 and Hall, et al., (2002) Science 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognize that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including in particular Western corn rootworm as a means to control insect infestation. Furthermore, PCT Publication WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein 527A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a *Beta*-Tubulin Homologous Sequence, a 40 kDa V-ATPase Homologous Sequence, a EF1a Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art. See, for example U.S. Pat. No. 5,039,523 and EP 0480762A2.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the PtIP-50 polypeptide or the PtIP-65 polypeptide, and desirably, provide for improved protection of the pesticide from environmental degradation and inactivation.

Such microorganisms include bacteria, algae, and fungi. Of particular interest are microorganisms such as bacteria, e.g., *Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc,* and *Alcaligenes,* fungi, particularly yeast, e.g., *Saccharomyces, Cryptococcus, Kluyveromyces, Sporobolomyces, Rhodotorula,* and *Aureobasidium*. Of particular interest are such phytosphere bacterial species as *Pseudomonas syringae, Pseudomonas fluorescens, Pseudomonas chlororaphis, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinelandii* and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae,*

*Sporobolomyces roseus, S. odorus, Kluyveromyces veronae,* and *Aureobasidium pollulans.* Of particular interest are the pigmented microorganisms. Host organisms of particular interest include yeast, such as *Rhodotorula* spp., *Aureobasidium* spp., *Saccharomyces* spp. (such as *S. cerevisiae*), *Sporobolomyces* spp., phylloplane organisms such as *Pseudomonas* spp. (such as *P. aeruginosa, P. fluorescens, P. chlororaphis*), *Erwinia* spp., and *Flavobacterium* spp., and other such organisms, including *Agrobacterium tumefaciens, E. coli, Bacillus subtilis, Bacillus cereus* and the like.

Genes encoding the PtIP-50 polypeptide and/or the PtIP-65 polypeptide of the embodiments can be introduced into microorganisms that multiply on plants (epiphytes) to deliver PtIP-50 polypeptide and/or the PtIP-65 polypeptides to potential target pests. Epiphytes, for example, can be gram-positive or gram-negative bacteria.

Root-colonizing bacteria, for example, can be isolated from the plant of interest by methods known in the art. Specifically, a *Bacillus cereus* strain that colonizes roots can be isolated from roots of a plant (see, for example, Handelsman et al. (1991) *Appl. Environ. Microbiol.* 56:713-718). Genes encoding the PtIP-50 polypeptide and/or the PtIP-65 polypeptide of the embodiments can be introduced into a root-colonizing *Bacillus cereus* by standard methods known in the art.

Genes encoding PtIP-50 polypeptides and/or the PtIP-65 polypeptides can be introduced, for example, into the root-colonizing *Bacillus* by means of electro transformation. Specifically, genes encoding the PtIP-50 polypeptides and/or the PtIP-65 polypeptides can be cloned into a shuttle vector, for example, pHT3101 (Lerecius, et al., (1989) *FEMS Microbiol. Letts.* 60:211-218. The shuttle vector pHT3101 containing the coding sequence for the particular PtIP-50 polypeptide and/or the PtIP-65 polypeptide gene can, for example, be transformed into the root-colonizing *Bacillus* by means of electroporation (Lerecius, et al., (1989) *FEMS Microbiol. Letts.* 60:211-218).

Expression systems can be designed so that PtIP-50 polypeptides and/or the PtIP-65 polypeptides are secreted outside the cytoplasm of gram-negative bacteria, such as *E. coli,* for example. Advantages of having a PtIP-50 polypeptide and/or a PtIP-65 polypeptide secreted are: (1) avoidance of potential cytotoxic effects of the PtIP-50 polypeptide and/or the PtIP-65 polypeptide expressed; and (2) improvement in the efficiency of purification of the PtIP-50 polypeptide and/or the PtIP-65 polypeptide, including, but not limited to, increased efficiency in the recovery and purification of the protein per volume cell broth and decreased time and/or costs of recovery and purification per unit protein.

PtIP-50 polypeptides and/or the PtIP-65 polypeptides can be made to be secreted in *E. coli,* for example, by fusing an appropriate *E. coli* signal peptide to the amino-terminal end of the PtIP-50 polypeptide and/or the PtIP-65 polypeptide. Signal peptides recognized by *E. coli* can be found in proteins already known to be secreted in *E. coli,* for example the OmpA protein (Ghrayeb, et al., (1984) *EMBO J,* 3:2437-2442). OmpA is a major protein of the *E. coli* outer membrane, and thus its signal peptide is thought to be efficient in the translocation process. Also, the OmpA signal peptide does not need to be modified before processing as may be the case for other signal peptides, for example lipoprotein signal peptide (Duffaud, et al., (1987) *Meth. Enzymol.* 153: 492).

PtIP-50 polypeptides and/or the PtIP-65 polypeptides of the embodiments can be fermented in a bacterial host and the resulting bacteria processed and used as a microbial spray in the same manner that Bt strains have been used as insecticidal sprays. In the case of a PtIP-50 polypeptide(s) and/or the PtIP-65 polypeptide(s) that is secreted from *Bacillus,* the secretion signal is removed or mutated using procedures known in the art. Such mutations and/or deletions prevent secretion of the PtIP-50 polypeptide(s) and/or the PtIP-65 polypeptide(s) into the growth medium during the fermentation process. The PtIP-50 polypeptide and/or the PtIP-65 polypeptide are retained within the cell, and the cells are then processed to yield the encapsulated PtIP-50 polypeptide and/or the PtIP-65 polypeptide. Any suitable microorganism can be used for this purpose. *Pseudomonas* has been used to express Bt toxins as encapsulated proteins and the resulting cells processed and sprayed as an insecticide (Gaertner, et al., (1993), in: *Advanced Engineered Pesticides,* ed. Kim).

Alternatively, the PtIP-50 polypeptide and/or the PtIP-65 polypeptide are produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated PtIP-50 polypeptide and/or the PtIP-65 polypeptide may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agrochemical composition that contains at least one of the PtIP-50 polypeptide and/or the PtIP-65 polypeptide produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, loxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, lodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-) Dimethenamid, Glufosinate, Glyphosate, Isoxaflutole, (S-) Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluoroethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-) Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluoroethyl)amino]furan-2(5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluoroethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluoroethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* J E Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira (Xylomyges) curialis* Grote (*citrus* cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (*sorghum* borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenee (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenee (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rosslerstamm (summer fruit tortrix moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermuller (European grape vine moth); *Spilonota ocellana* Denis & Schiffermuller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Gurin-Meneville (Chinese Oak Tussah Moth); *Bombyx mori* Linnaeus (Silkworm); *Bucculatrix thurberiella* Busck (cotton leaf perforator); *Collas eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Gurin-Meneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phtyganidia californica* Packard (California oakworm); *Phyllocnistis citrella* Stainton (*citrus* leafminer); *Phyllonotycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenee (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenee; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape *colaspis*); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (*sorghum* midge); *Mayetiola destructor* Say (Hessian fly); *Sitodiplosis mosellana* Gehin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, *phylloxera* from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea*

Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black *citrus* aphid) and *T. citricida* Kirkaldy (brown *citrus* aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (*citrus* whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stal (rice leafhopper); *Nilaparvata lugens* Stal (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (*citrus* mealybug); *Pseudococcus* spp. (other mealybug complex); *Cacopsylla pyricola* Foerster (pear *psylla*); *Trioza diospyri* Ashmead (persimmon *psylla*).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schaffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; Coreidae spp.; Pyrrhocoridae spp.; Tinidae spp.; Blostomatidae spp.; Reduviidae spp. and Cimicidae spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (*citrus* flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (*Bagrada* Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated with one or more of the insecticidal proteins or polypeptides disclosed herein. For e.g., such seed treatments can be applied on seeds that contain a transgenic trait including transgenic corn, soy, brassica, cotton or rice. Combinations of one or more of the insecticidal proteins or polypeptides disclosed herein and other conventional seed treatments are contemplated. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum*, liaonigense, *pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, *penicillium*, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, *trichoderma*, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest, either simultaneously or sequentially, with an insecticidally-effective amount of a recombinant PtIP-50 polypeptide and PtIP-65 polypeptide. In some embodiments methods are provided for killing an insect pest, comprising contacting the insect pest with an insecticidally-effective amount of a recombinant pesticidal protein of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or a variant thereof.

In some embodiments methods are provided for controlling an insect pest population, comprising contacting the insect pest population, either simultaneously or sequentially, with an insecticidally-effective amount of a recombinant PtIP-50 polypeptide and PtIP-65 polypeptide. In some embodiments methods are provided for controlling an insect pest population, comprising contacting the insect pest population with an insecticidally-effective amount of a recombinant PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population, either simultaneously or sequentially, with an insecticidally-effective amount of a recombinant PtIP-50 polypeptide and a recombinant PtIP-65 polypeptide. In some embodiments methods are provided for controlling an insect pest population resistant to a pesticidal protein, comprising contacting the insect pest population with an insecticidally-effective amount of a recombinant PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or the PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or a variant thereof.

In some embodiments methods are provided for protecting a plant from an insect pest, comprising expressing in the plant or cell thereof at least one recombinant polynucleotide encoding a PtIP-50 polypeptide and a recombinant PtIP-65 polypeptide. In some embodiments methods are provided for protecting a plant from an insect pest, comprising expressing in the plant or cell thereof a recombinant polynucleotide encoding PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or variants thereof.

In some embodiments methods are provided for protecting a plant from an insect pest, comprising expressing in the plant or cell thereof at least one recombinant polynucleotide encoding a PtIP-50 polypeptide and a recombinant PtIP-65 polypeptide. In some embodiments methods are provided for protecting a plant from an insect pest, comprising expressing in the plant or cell thereof a recombinant polynucleotide encoding a PtIP-50 polypeptide of any one of SEQ ID NO: 224-326.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the PtIP-50 polypeptide and PtIP-65 polypeptide of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management the at least one of the insecticidal proteins comprise a PtIP-50 polypeptide and PtIP-65 polypeptide insecticidal to insects in the order Lepidoptera and/or Coleoptera.

In some embodiments the methods of controlling Lepidoptera and/or Coleoptera insect infestation in a transgenic plant and promoting insect resistance management comprise expressing at least one of the PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or a PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or variants thereof, insecticidal to insects in the order Lepidoptera and/or Coleoptera.

In some embodiments the methods of controlling Lepidoptera and/or Coleoptera insect infestation in a transgenic plant and promoting insect resistance management comprise expressing in the transgenic plant a PtIP-50 polypeptide and PtIP-65 polypeptide and a Cry protein insecticidal to insects in the order Lepidoptera and/or Coleoptera having different modes of action.

In some embodiments the methods of controlling Lepidoptera and/or Coleoptera insect infestation in a transgenic plant and promoting insect resistance management comprise expressing in the transgenic plant a PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or a PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or variants thereof and a Cry protein insecticidal to insects in the order Lepidoptera and/or Coleoptera having different modes of action.

Also provided are methods of reducing likelihood of emergence of Lepidoptera and/or Coleoptera insect resistance to transgenic plants expressing in the plants insecticidal proteins to control the insect species, comprising expression of a PtIP-50 polypeptide and a PtIP-65 polypeptide insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a PtIP-50 polypeptide and PtIP-65 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise a PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or variants thereof and a Cry protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the PtIP-50 polypeptide and the PtIP-65 polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the PtIP-50 polypeptide of SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69 or SEQ ID NO: 70 and/or the PtIP-65 polypeptide of SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41 or SEQ ID NO: 42 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing a PtIP-50 polypeptide and a PtIP-65 polypeptide disclosed herein. Expression of the PtIP-50 polypeptide and the PtIP-65 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising a PtIP-50 polypeptide and a PtIP-65 polypeptide. The plants, plant parts or seeds provided herein, can be processed to yield oil, protein products and/or by-products that are derivatives obtained by processing that have commercial value. Non-limiting examples include transgenic seeds comprising a nucleic acid molecule encoding a PtIP-50 polypeptide and a PtIP-65 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXPERIMENTALS

Example 1—Identification of an Insecticidal Protein Active from the Fern, *Asplenium australasicum*, (PS-8566)

The insecticidal proteins PtIP-50Aa and PtIP-65Aa were identified by protein purification, mass spectroscopy (MS) and PCR cloning from *Asplenium* australasicum, PS-8566 as follows.

*Asplenium australasicum* was collected by a collaborator and assigned identification number PS-8566. A voucher specimen of *Asplenium australasicum* was sent to the Delaware State University Herbarium where the identity was verified. PS-8566 was collected, flash frozen in liquid $N_2$ and stored at −80° C. After storage it was ground to a fine powder at liquid $N_2$ temperatures with a Geno Ball Mill (SPEX, Metuchen, N.J.). To extract protein, 20 ml of 50 mM Tris buffer, pH 8.0, 150 mM KCl, 2.5 mM EDTA, 1.5% polyvinylpolypyrrolidone (PVPP) and protease inhibitor cocktail (Roche Diagnostics, Germany) was added to every 5 g fresh weight of tissue. The homogenate was centrifuged to remove cell debris, filtered through 0.22 um filters and desalted using 10 ml Zeba Spin Desalting columns (Thermo Scientific, IL.)

Bioassays against the three pest species, Soybean Looper (SBL) (*Pseudoplusia includens*), Corn Earworm (CEW) (*Helicoverpa zea*) and European Corn Borer (ECB) (*Ostrinia nubialis*) were conducted using the desalted protein extract overlaid onto an agar-based Lepidoptera diet (Southland Products Inc., Lake Village, Ark.) in a 96-well plate format.

Six replicates were used per sample. Samples were allowed to dry on top of the diet and two to five neonate insects were placed into each well of the treated plate. After four days of incubation at 27° C. larvae were scored for mortality or severity of stunting. The scores were recorded numerically as dead (3), severely stunted (2) (little or no growth but alive and equivalent to a $1^{st}$ instar larvae), stunted (1) (growth to second instar but not equivalent to controls), or normal (0). Subjecting the sample to proteinase K and heat treatments resulted in loss of activity indicating that the sample was proteinaceous in nature. Bioassay results are shown in Table 7.

TABLE 7

Activity of *A. australasicum* protein extract against lepidoptera larvae

| | | Ave. Score | Ave. Score after Proteinase K/Heat |
|---|---|---|---|
| Neonate | Soybean Looper | 3 | 0 |
| | Corn Earworm | 2 | 0 |
| | European Corn Borer | 1.5 | 0 |

For protein purification, PS-8566 was ground to a fine powder at liquid $N_2$ temperatures with a Geno Ball Mill (SPEX, Metuchen, N.J.). Protein was extracted in 50 mM Tris buffer, pH 8.0, 150 mM KCl, 2.5 mM EDTA, 1.5% PVPP and protease inhibitor cocktail (Roche Diagnostics, Germany). The extracted material was centrifuged to remove cell debris, filtered through 0.22 um filters and desalted using a HiPrep 26/10 desalting column (GE, Piscataway, N.J.). The desalted fractions were assayed against CEW and SBL as described above. The active protein fraction pool was loaded onto a 5 ml HiTrap Q column (GE, Piscataway, N.J.) and eluted with a linear (30 CV) gradient from 0 M to 0.6 M NaCl in 50 mM Tris, pH 8.0, The active fractions were combined, concentrated by Amicon molecular weight cutoff filtration (Millipore, Billerica, Mass.), and loaded onto a HiLoad™ Superdex™ 200, 16/60 Size exclusion column (GE, Piscataway, N.J.) and eluted with 50 mM Tris buffer, pH 8.0, 150 mM NaCl. Fractions active against SBL and CEW were combined, concentrated and then further diluted with 50 mM Tris buffer, pH 8 to reduce the salt concentration and loaded onto a Mono Q® 5/50 column (GE, Piscataway N.J.). Fractions eluted from the Mono Q® 5/50 column with a 0 to 0.7M NaCl gradient over 200 CV were assayed against SBL and CEW. Based on LDS-PAGE the active fraction contained two protein bands at approximately 89 kDa and 35 kDa. The two bands were designated with internal names to be used hereafter. The protein representing the 89 kDa band was named PtIP-50Aa (SEQ ID NO: 71) and the protein representing the 35 kDa band was named PtIP-65Aa (SEQ ID NO: 22).

Protein sequencing and identification was performed by MS analysis after protein digestion with trypsin. Proteins for MS identification were obtained after running the sample on an LDS-PAGE gel stained with Brilliant Blue G-250 Stain. The two bands of interest were excised from the gel, de-stained, reduced with dithiothreitol and then alkylated with iodoacetamide. Following overnight digestion with trypsin, the samples were submitted for LCMS analysis. Liquid chromatography-tandem mass spectrometry (LC-MSMS) analysis for tryptically-digested peptides was conducted using electrospray on a QToF Premiere™ mass spectrometer (Waters®, Milford, Mass.) coupled with a NanoAcquity™ nano-LC system (Waters®, Milford, Mass.) with a gradient from 2% acetonitrile, 0.1% formic acid to 60% acetonitrile, 0.1% formic acid.

The resulting LCMS data were analyzed using Protein Lynx Global Server (Waters®, Milford, Mass.) to generate DeNovo sequence data. The amino acid sequences were BLAST (Basic Local Alignment Search Tool; Altschul, et al., (1993) *J. Mol. Biol.* 215:403-410; see also ncbi.nlm.nih.gov/BLAST/, which can be accessed using the www prefix) searched against public and DUPONT-PIONEER internal databases that included plant protein sequences. Amino acid sequences were aligned with proteins in a proprietary DUPONT-PIONEER plant protein database.

Example 2—Transcriptomic Sequencing of PtIP-50 and PtIP-65

A transcriptome for *Asplenium australasicum*, PS-8566 was prepared as follows. Total RNAs were isolated from frozen tissues by use of the Qiagen® RNeasy® kit for total RNA isolation. Sequencing libraries from the resulting total RNAs were prepared using the TruSeq™ mRNA-Seq kit and protocol from Illumina®, Inc. (San Diego, Calif.). Briefly, mRNAs were isolated via attachment to oligo(dT) beads, fragmented to a mean size of 180 nt, reverse transcribed into cDNA by random hexamer prime, end repaired, 3' A-tailed, and ligated with Illumina® indexed TruSeq™ adapters. Ligated cDNA fragments were PCR amplified using Illumina® TruSeq™ primers and purified PCR products were checked for quality and quantity on the Agilent Bioanalyzer® DNA 7500 chip. Post quality and quantity assessment, 100 ng of the transcript library was normalized by treatment with Duplex Specific Nuclease (DSN) (Evrogen®, Moscow, Russia). Normalization was accomplished by addition of 200 mM Hepes buffer, followed by heat denaturation and five hour anneal at 68° C. Annealed library was treated with 2 ul of DSN enzyme for 25 minutes, purified by Qiagen® MinElute® columns according to manufacturer protocols, and amplified twelve cycles using Illumina® adapter specific primers. Final products were purified with Ampure® XP beads (Beckman Genomics, Danvers, Mass.) and checked for quality and quantity on the Agilent Bioanalyzer® DNA 7500 chip.

Normalized transcript libraries were sequenced according to manufacturer protocols on the Illumina® Genome Analyzer IIx. Each library was hybridized to two flowcell lanes and amplified, blocked, linearized and primer hybridized using the Illumina clonal cluster generation process on cBot®. Sequencing was completed on the Genome Analyzer IIx, generating sixty million 75 bp paired end reads per normalized library.

Peptide sequences identified for PtIP-50Aa (SEQ ID NO: 71) by LC-MS/MS/MS sequencing (described in Example 1) were searched against the protein sequences predicted by open reading frames (ORFs) from the internal transcriptome for PS-8566 assemblies. The peptides gave a perfect match to a transcript corresponding to PtIP-50Aa (SEQ ID NO: 71). Amino acid sequence stretches identified for PtIP-65Aa (SEQ ID NO: 22) by LC-MS/MS/MS sequencing were searched against the proteins predicted by open reading frames (ORFs) of the contig assemblies. The peptides gave perfect matches to another transcript corresponding to PtIP-65Aa (SEQ ID NO: 22).

The coding sequences were used to design the following primers to clone the PtIP-50Aa coding sequence: CGAAT-TCGAGCACATATGGCCGCC (95KD N-T Ndel for) (SEQ ID NO: 202) and GATTCCGGATCCTTATACGGC-GACTCTGG (95KD C-T BamHI REV) (SEQ ID NO: 203). This clone was produced by polymerase chain reaction using the HF Advantage® PCR kit (Clontech™, 1290 Terra Bella Ave. Mountain View, Calif. 94043) and the total RNA from *Asplenium australasicum* as a template. The cloned sequence was confirmed by sequencing.

The coding sequences were used to design the following primers to clone the PtIP-65Aa coding sequence: GGATA-CACCTCATATGGCGTTGGTGATCGG (36KD N-T Ndel for) (SEQ ID NO: 204) and GTGCGGGATCCCTACT-GAGTGGTGATGTCAATCGCG (36KD C-T BamHI REV) (SEQ ID NO: 205). This clone was produced by polymerase chain reaction using the HF Advantage® PCR kit (Clontech™, 1290 Terra Bella Ave. Mountain View, Calif. 94043) and the total RNA from *Asplenium australasicum* as a template. The cloned sequence was confirmed by sequencing.

Based on the DNA and protein sequencing, the PtIP-50Aa polynucleotide sequence is provided as SEQ ID NO: 43 and the polypeptide sequence as SEQ ID NO: 71. The PtIP-65Aa polynucleotide sequence is provided as SEQ ID NO: 1 and the polypeptide sequence as SEQ ID NO: 22.

Example 3:—Identification of PtIP-50 and PtIP-65 Homologs

Gene identities may be determined by conducting BLAST (Basic Local Alignment Search Tool; Altschul, et al., (1993) *J. Mol. Biol.* 215:403-410; see also ncbi.nlm.nih.gov/BLAST/, which can be accessed using the www prefix) searches under default parameters for similarity to sequences. The polynucleotide sequences for PtIP-50Aa (SEQ ID NO: 43) and PtIP-65Aa (SEQ ID NO: 1) were analyzed. Gene identities conducted by BLAST in a DUPONT PIONEER internal transcriptomes database of ferns and other primitive plants identified multiple homologs for both PtIP-50Aa (SEQ ID NO: 71) and PtIP-65Aa (SEQ ID NO: 22) within a range of homologies. Table 8 shows the Plant Sample ID #, fern or other primitive plant species, internal clone designation and the respective sequence identifiers for the PtIP-65 polypeptide homologs and polynucleotides encoding the PtIP-50 homologs. Table 9 shows the Plant Sample ID #, fern or other primitive plant species, internal clone designation and the respective sequence identifiers for the PtIP-65 polypeptide homologs and polynucleotides encoding the PtIP-50 homologs.

TABLE 8

| Plant Sample ID | Species | name | n.a. seq | a.a. seq |
|---|---|---|---|---|
| PS-8566 | *Asplenium australasicum* | PtIP-65Aa | SEQ ID NO: 1 | SEQ ID NO: 22 |
| PS-9140 | *Asplenium × kenzoi Sa. Kurata* | PtIP-65Hc | SEQ ID NO: 2 | SEQ ID NO: 23 |
| PS-8568 | *Polypodium musifolium* | PtIP-65Ba | SEQ ID NO: 3 | SEQ ID NO: 24 |
|  |  | PtIP-65Ha | SEQ ID NO: 4 | SEQ ID NO: 25 |
| PS-9319 | *Polypodium punctatum 'Serratum'* | PtIP-65Bb | SEQ ID NO: 5 | SEQ ID NO: 26 |
|  |  | PtIP-65Gc | SEQ ID NO: 6 | SEQ ID NO: 27 |
|  |  | PtIP-65Hd | SEQ ID NO: 7 | SEQ ID NO: 28 |
| PS-7140 | *Adiantum pedatum* L. | PtIP-65Ca | SEQ ID NO: 8 | SEQ ID NO: 29 |
| PS-9135 | *Platycerium bifurcatum* | PtIP-65Ga | SEQ ID NO: 9 | SEQ ID NO: 30 |
|  |  | PtIP-65Hb | SEQ ID NO: 10 | SEQ ID NO: 31 |
| PS-8837 | *Nephrolepis falcata* | PtIP-65He | SEQ ID NO: 11 | SEQ ID NO: 32 |
|  |  | PtIP-65Hf | SEQ ID NO: 12 | SEQ ID NO: 33 |

TABLE 8-continued

| Plant Sample ID | Species | name | n.a. seq | a.a. seq |
|---|---|---|---|---|
| PS-9145 | Ophioglossum pendulum | PtIP-65Gb | SEQ ID NO: 13 | SEQ ID NO: 34 |
| PS-9427 | Colysis wrightii 'Monstifera' | PtIP-65Gd | SEQ ID NO: 14 | SEQ ID NO: 35 |
| PS-7897 | Colysis wrightii | PtIP-65Ge | SEQ ID NO: 15 | SEQ ID NO: 36 |
|  |  | PtIP-65Hk | SEQ ID NO: 16 | SEQ ID NO: 37 |
| PS-8780 | Selaginella kraussiana 'Variegata' | PtIP-65Hh | SEQ ID NO: 17 | SEQ ID NO: 38 |
|  |  | PtIP-65Hj | SEQ ID NO: 18 | SEQ ID NO: 39 |
| PS-7896 | Selaginella victoriae | PtIP-65Hg | SEQ ID NO: 19 | SEQ ID NO: 40 |
| PS-8582 | Lycopodium phlegmaria | PtIP-65Fa | SEQ ID NO: 20 | SEQ ID NO: 41 |
| PS-9141 | Huperzia salvinioides | PtIP-65Fb | SEQ ID NO: 21 | SEQ ID NO: 42 |

TABLE 9

| Plant Sample ID | Species | name | n.a. seq | a.a. seq |
|---|---|---|---|---|
| PS-8566 | Asplenium australasicum | PtIP-50Aa | SEQ ID NO: 43 | SEQ ID NO: 71 |
|  |  | PtIP-50Fb | SEQ ID NO: 44 | SEQ ID NO: 72 |
| PS-8564 | Asplenium nidus | PtIP-50Fo | SEQ ID NO: 45 | SEQ ID NO: 73 |
| PS-9140 | Asplenium × kenzoi Sa. Kurata | PtIP-50Fs | SEQ ID NO: 46 | SEQ ID NO: 74 |
|  |  | PtIP-50Fr | SEQ ID NO: 47 | SEQ ID NO: 75 |
|  |  | PtIP-50Gc | SEQ ID NO: 48 | SEQ ID NO: 76 |
| PS-8568 | Polypodium musifolium | PtIP-50Ba | SEQ ID NO: 49 | SEQ ID NO: 77 |
| PS-9319 | Polypodium punctatum 'Serratum' | PtIP-50Bc | SEQ ID NO: 50 | SEQ ID NO: 78 |
|  |  | PtIP-50Fe | SEQ ID NO: 51 | SEQ ID NO: 79 |
|  |  | PtIP-50Gb | SEQ ID NO: 52 | SEQ ID NO: 78 |
|  |  | PtIP-50Fh | SEQ ID NO: 53 | SEQ ID NO: 81 |
|  |  | PtIP-50Fg | SEQ ID NO: 54 | SEQ ID NO: 82 |
|  |  | PtIP-50Ff | SEQ ID NO: 55 | SEQ ID NO: 83 |
| PS-7140 | Adiantum pedatum L. | PtIP-50Bb | SEQ ID NO: 56 | SEQ ID NO: 84 |
|  |  | PtIP-50Ft | SEQ ID NO: 57 | SEQ ID NO: 85 |
|  |  | PtIP-50Fa | SEQ ID NO: 58 | SEQ ID NO: 86 |
| PS-9135 | Platycerium bifurcatum | PtIP-50Fd | SEQ ID NO: 59 | SEQ ID NO: 87 |
|  |  | PtIP-50Ga | SEQ ID NO: 60 | SEQ ID NO: 88 |
| PS-8837 | Nephrolepis falcata | PtIP-50Fk | SEQ ID NO: 61 | SEQ ID NO: 89 |
|  |  | PtIP-50Fi | SEQ ID NO: 62 | SEQ ID NO: 90 |
|  |  | PtIP-50Fj | SEQ ID NO: 63 | SEQ ID NO: 91 |
|  |  | PtIP-50Gd | SEQ ID NO: 64 | SEQ ID NO: 92 |
| PS-9427 | Colysis wrightii 'Monstifera' | PtIP-50Fn | SEQ ID NO: 65 | SEQ ID NO: 93 |
| PS-7897 | Colysis wrightii | PtIP-50Fl | SEQ ID NO: 66 | SEQ ID NO: 94 |
|  |  | PtIP-50Fq | SEQ ID NO: 67 | SEQ ID NO: 95 |
| PS-9321 | Bolbitis cladorrhizans | PtIP-50Bd | SEQ ID NO: 68 | SEQ ID NO: 96 |
|  |  | PtIP-50Fp | SEQ ID NO: 69 | SEQ ID NO: 97 |
| PS-9537 | Blechnum brasiliense 'Crispum' | PtIP-50Fm | SEQ ID NO: 70 | SEQ ID NO: 98 |

TABLE 10

|  | PtIP-50Ba | PtIP-50Bb | PtIP-50Bc | PtIP-50Bd | PtIP-50Fa | PtIP-50Fb | PtIP-50Fd | PtIP-50Fe | PtIP-50Ff | PtIP-50Fg | PtIP-50Fh | PtIP-50Fi | PtIP-50Fj | PtIP-50Fk |
|---|---|---|---|---|---|---|---|---|---|---|---|---|---|---|
| PtIP-50Aa | 86.3 | 84.8 | 83.0 | 88.4 | 46.3 | 48.4 | 46.9 | 48.9 | 51.3 | 46.1 | 47.7 | 48.4 | 50.9 | 46.1 |
| PtIP-50Ba | — | 79.3 | 87.5 | 81.3 | 45.7 | 47.9 | 45.7 | 49.4 | 51.2 | 45.4 | 46.4 | 46.9 | 49.2 | 46.3 |
| PtIP-50Bb | — | — | 76.5 | 85.9 | 47.4 | 48.9 | 47.4 | 49.6 | 52.9 | 46.9 | 48.4 | 49.7 | 52.2 | 47.6 |
| PtIP-50Bc | — | — | — | 78.1 | 45.0 | 47.1 | 45.9 | 47.9 | 48.8 | 45.2 | 45.8 | 45.3 | 48.6 | 45.2 |
| PtIP-50Bd | — | — | — | — | 47.3 | 49.3 | 48.2 | 49.7 | 52.6 | 47.4 | 49.2 | 48.6 | 51.8 | 46.3 |
| PtIP-50Fa | — | — | — | — | — | 44.0 | 39.5 | 42.6 | 58.4 | 40.9 | 40.2 | 49.9 | 55.6 | 40.9 |
| PtIP-50Fb | — | — | — | — | — | — | 52.3 | 71.7 | 46.9 | 51.2 | 51.4 | 44.5 | 45.4 | 77.9 |
| PtIP-50Fd | — | — | — | — | — | — | — | 52.5 | 44.8 | 67.1 | 64.2 | 42.8 | 43.8 | 50.7 |
| PtIP-50Fe | — | — | — | — | — | — | — | — | 46.6 | 52.4 | 52.1 | 44.6 | 44.6 | 69.7 |
| PtIP-50Ff | — | — | — | — | — | — | — | — | — | 45.0 | 44.0 | 56.6 | 64.1 | 43.8 |
| PtIP-50Fg | — | — | — | — | — | — | — | — | — | — | 65.9 | 42.8 | 43.5 | 50.0 |
| PtIP-50Fh | — | — | — | — | — | — | — | — | — | — | — | 43.5 | 44.0 | 50.0 |
| PtIP-50Fi | — | — | — | — | — | — | — | — | — | — | — | — | 60.8 | 42.1 |
| PtIP-50Fj | — | — | — | — | — | — | — | — | — | — | — | — | — | 42.4 |
| PtIP-50Fk | — | — | — | — | — | — | — | — | — | — | — | — | — | — |
| PtIP-50Fl | — | — | — | — | — | — | — | — | — | — | — | — | — | — |

TABLE 10-continued

|  | PtIP-50Fl | PtIP-50Fm | PtIP-50Fn | PtIP-50Fo | PtIP-50Fp | PtIP-50Fq | PtIP-50Fr | PtIP-50Fs | PtIP-50Ft | PtIP-50Ga | PtIP-50Gb | PtIP-50Gc | PtIP-50Gd |
|---|---|---|---|---|---|---|---|---|---|---|---|---|---|
| PtIP-50Fm | — | — | — | — | — | — | — | — | — | — | — | — | — |
| PtIP-50Fn | — | — | — | — | — | — | — | — | — | — | — | — | — |
| PtIP-50Fo | — | — | — | — | — | — | — | — | — | — | — | — | — |
| PtIP-50Fp | — | — | — | — | — | — | — | — | — | — | — | — | — |
| PtIP-50Fq | — | — | — | — | — | — | — | — | — | — | — | — | — |
| PtIP-50Fr | — | — | — | — | — | — | — | — | — | — | — | — | — |
| PtIP-50Fs | — | — | — | — | — | — | — | — | — | — | — | — | — |
| PtIP-50Ft | — | — | — | — | — | — | — | — | — | — | — | — | — |
| PtIP-50Ga | — | — | — | — | — | — | — | — | — | — | — | — | — |
| PtIP-50Gb | — | — | — | — | — | — | — | — | — | — | — | — | — |
| PtIP-50Gc | — | — | — | — | — | — | — | — | — | — | — | — | — |

|  | PtIP-50Fl | PtIP-50Fm | PtIP-50Fn | PtIP-50Fo | PtIP-50Fp | PtIP-50Fq | PtIP-50Fr | PtIP-50Fs | PtIP-50Ft | PtIP-50Ga | PtIP-50Gb | PtIP-50Gc | PtIP-50Gd |
|---|---|---|---|---|---|---|---|---|---|---|---|---|---|
| PtIP-50Aa | 47.6 | 46.6 | 48.1 | 45.1 | 41.4 | 49.4 | 46.2 | 47.7 | 51.1 | 32.9 | 33.4 | 35.2 | 33.5 |
| PtIP-50Ba | 47.8 | 46.4 | 47.8 | 44.8 | 40.7 | 49.1 | 45.7 | 47.8 | 50.5 | 31.5 | 32.1 | 33.4 | 32.3 |
| PtIP-50Bb | 48.0 | 47.8 | 49.1 | 45.4 | 41.7 | 50.7 | 47.1 | 47.8 | 52.3 | 32.4 | 33.3 | 33.8 | 33.7 |
| PtIP-50Bc | 46.0 | 45.9 | 47.1 | 44.0 | 40.5 | 47.4 | 44.8 | 46.1 | 49.6 | 32.2 | 32.8 | 33.3 | 32.4 |
| PtIP-50Bd | 48.4 | 47.7 | 49.1 | 45.6 | 41.2 | 51.3 | 47.4 | 48.1 | 52.9 | 33.3 | 34.2 | 34.8 | 33.6 |
| PtIP-50Fa | 42.2 | 40.3 | 43.7 | 40.7 | 37.5 | 57.4 | 38.9 | 43.8 | 45.4 | 33.2 | 32.6 | 33.8 | 31.5 |
| PtIP-50Fb | 68.4 | 52.6 | 71.9 | 76.0 | 40.6 | 46.3 | 51.0 | 88.8 | 59.4 | 33.1 | 31.7 | 32.4 | 33.2 |
| PtIP-50Fd | 51.9 | 83.5 | 54.0 | 49.2 | 38.1 | 43.4 | 84.3 | 52.5 | 56.6 | 32.4 | 31.8 | 31.6 | 31.0 |
| PtIP-50Fe | 81.8 | 52.8 | 85.2 | 66.5 | 42.2 | 46.1 | 51.7 | 71.4 | 60.6 | 33.0 | 32.4 | 32.5 | 32.8 |
| PtIP-50Ff | 45.4 | 45.3 | 47.5 | 44.2 | 39.4 | 89.8 | 44.1 | 46.2 | 49.7 | 32.1 | 32.7 | 32.8 | 31.6 |
| PtIP-50Fg | 50.8 | 66.0 | 53.3 | 48.6 | 38.4 | 44.3 | 65.7 | 51.4 | 56.7 | 31.0 | 29.6 | 32.3 | 30.4 |
| PtIP-50Fh | 51.7 | 65.3 | 53.3 | 48.6 | 39.1 | 43.4 | 63.9 | 51.0 | 55.3 | 31.0 | 30.5 | 30.8 | 31.0 |
| PtIP-50Fi | 42.6 | 42.9 | 44.3 | 41.0 | 40.2 | 55.5 | 42.7 | 43.8 | 46.7 | 32.6 | 32.7 | 33.3 | 30.8 |
| PtIP-50Fj | 44.4 | 43.2 | 45.5 | 41.9 | 38.7 | 62.5 | 42.6 | 49.2 | 31.1 | 31.7 | 31.3 | 30.7 |
| PtIP-50Fk | 67.5 | 51.7 | 70.7 | 76.4 | 38.3 | 43.4 | 50.3 | 76.5 | 55.4 | 33.5 | 32.2 | 32.8 | 32.8 |
| PtIP-50Fl | — | 52.0 | 86.2 | 63.3 | 40.9 | 45.2 | 51.1 | 68.0 | 57.8 | 32.3 | 31.3 | 32.4 | 32.5 |
| PtIP-50Fm | — | — | 54.3 | 51.2 | 39.4 | 44.6 | 84.7 | 53.3 | 56.5 | 32.6 | 31.8 | 31.8 | 31.8 |
| PtIP-50Fn | — | — | — | 66.2 | 41.2 | 45.9 | 52.7 | 71.2 | 60.9 | 33.3 | 32.5 | 32.5 | 33.4 |
| PtIP-50Fo | — | — | — | — | 37.9 | 44.2 | 48.7 | 79.4 | 54.1 | 32.5 | 32.6 | 32.7 | 32.7 |
| PtIP-50Fp | — | — | — | — | — | 39.8 | 38.7 | 40.4 | 41.9 | 39.3 | 39.6 | 39.9 | 38.3 |
| PtIP-50Fq | — | — | — | — | — | — | 44.2 | 45.7 | 48.2 | 31.3 | 32.4 | 32.2 | 30.6 |
| PtIP-50Fr | — | — | — | — | — | — | — | 51.8 | 55.9 | 31.7 | 31.1 | 31.4 | 30.6 |
| PtIP-50Fs | — | — | — | — | — | — | — | — | 58.6 | 33.4 | 31.9 | 32.9 | 33.0 |
| PtIP-50Ft | — | — | — | — | — | — | — | — | — | 33.5 | 32.6 | 34.0 | 32.9 |
| PtIP-50Ga | — | — | — | — | — | — | — | — | — | — | 85.9 | 87.4 | 77.2 |
| PtIP-50Gb | — | — | — | — | — | — | — | — | — | — | — | 90.4 | 75.2 |
| PtIP-50Gc | — | — | — | — | — | — | — | — | — | — | — | — | 77.6 |

Moreover, tables summarizing the global identity are presented in Table 10 and Table 11. Percent identity values were calculated using ClustalW algorithm in the ALIGNX® module of the Vector NTI® Program Suite (Invitrogen™ Corporation, Carlsbad, Calif.) with all default parameters.

TABLE 11

|  | PtIP-65Ba | PtIP-65Bb | PtIP-65Ca | PtIP-65Fa | PtIP-65Fb | PtIP-65Ga | PtIP-65Gb | PtIP-65Gc | PtIP-65Gd | PtIP-65Ge | PtIP-65Ha | PtIP-65Hb |
|---|---|---|---|---|---|---|---|---|---|---|---|---|
| PtIP-65Aa | 82.9 | 83.2 | 76.8 | 46.4 | 46.9 | 35.2 | 35.8 | 33.6 | 34.5 | 34.5 | 33.6 | 26.6 |
| PtIP-65Ba | — | 85.0 | 74.0 | 44.8 | 44.8 | 33.9 | 34.1 | 33.2 | 32.9 | 32.9 | 33.2 | 26.8 |
| PtIP-65Bb | — | — | 73.1 | 44.2 | 45.4 | 33.0 | 33.2 | 32.3 | 32.1 | 32.1 | 32.3 | 28.4 |
| PtIP-65Ca | — | — | — | 46.1 | 46.6 | 33.8 | 34.8 | 33.2 | 33.6 | 33.3 | 32.7 | 28.0 |
| PtIP-65Fa | — | — | — | — | 96.8 | 41.7 | 42.3 | 42.8 | 44.0 | 43.8 | 43.4 | 28.1 |
| PtIP-65Fb | — | — | — | — | — | 42.3 | 42.8 | 42.8 | 44.0 | 43.8 | 43.4 | 28.7 |
| PtIP-65Ga | — | — | — | — | — | — | 98.6 | 85.1 | 83.3 | 83.1 | 83.9 | 27.2 |
| PtIP-65Gb | — | — | — | — | — | — | — | 85.6 | 83.9 | 83.6 | 84.5 | 27.4 |
| PtIP-65Gc | — | — | — | — | — | — | — | — | 92.1 | 91.8 | 98.3 | 27.1 |
| PtIP-65Gd | — | — | — | — | — | — | — | — | — | 99.7 | 92.7 | 25.9 |
| PtIP-65Ge | — | — | — | — | — | — | — | — | — | — | 92.4 | 25.7 |
| PtIP-65Ha | — | — | — | — | — | — | — | — | — | — | — | 26.4 |
| PtIP-65Hb | — | — | — | — | — | — | — | — | — | — | — | — |
| PtIP-65Hc | — | — | — | — | — | — | — | — | — | — | — | — |
| PtIP-65Hd | — | — | — | — | — | — | — | — | — | — | — | — |
| PtIP-65He | — | — | — | — | — | — | — | — | — | — | — | — |
| PtIP-65Hf | — | — | — | — | — | — | — | — | — | — | — | — |
| PtIP-65Hg | — | — | — | — | — | — | — | — | — | — | — | — |
| PtIP-65Hh | — | — | — | — | — | — | — | — | — | — | — | — |
| PtIP-65Hj | — | — | — | — | — | — | — | — | — | — | — | — |
| PtIP-65Hk | — | — | — | — | — | — | — | — | — | — | — | — |

TABLE 11-continued

|  | PtIP-65Hc | PtIP-65Hd | PtIP-65He | PtIP-65Hf | PtIP-65Hg | PtIP-65Hh | PtIP-65Hj | PtIP-65Hk |
|---|---|---|---|---|---|---|---|---|
| PtIP-65Aa | 28.5 | 28.1 | 26.8 | 27.5 | 27.5 | 29.4 | 30.7 | 30.2 |
| PtIP-65Ba | 29.2 | 28.5 | 27.8 | 28.0 | 28.6 | 28.5 | 29.3 | 30.1 |
| PtIP-65Bb | 31.8 | 29.4 | 27.7 | 29.7 | 28.6 | 27.1 | 29.0 | 30.4 |
| PtIP-65Ca | 30.1 | 28.6 | 27.5 | 29.3 | 30.0 | 30.6 | 30.9 | 30.2 |
| PtIP-65Fa | 30.3 | 28.4 | 31.6 | 32.2 | 32.9 | 36.6 | 38.2 | 34.1 |
| PtIP-65Fb | 31.0 | 28.4 | 31.7 | 31.0 | 32.6 | 36.8 | 38.5 | 33.8 |
| PtIP-65Ga | 23.2 | 24.4 | 23.4 | 24.6 | 29.4 | 31.6 | 56.0 | 32.2 |
| PtIP-65Gb | 23.8 | 24.9 | 23.6 | 24.9 | 29.4 | 31.3 | 56.3 | 31.7 |
| PtIP-65Gc | 23.8 | 23.6 | 24.1 | 25.1 | 29.7 | 31.2 | 53.5 | 30.8 |
| PtIP-65Gd | 23.3 | 23.4 | 24.7 | 25.9 | 29.0 | 32.5 | 56.2 | 31.7 |
| PtIP-65Ge | 23.1 | 23.2 | 24.4 | 25.7 | 29.0 | 32.5 | 56.0 | 31.4 |
| PtIP-65Ha | 23.2 | 23.1 | 24.4 | 25.4 | 29.2 | 31.4 | 54.0 | 30.5 |
| PtIP-65Hb | 68.5 | 68.7 | 51.4 | 52.2 | 22.0 | 24.0 | 24.2 | 24.5 |
| PtIP-65Hc | — | 84.4 | 53.2 | 53.8 | 21.5 | 22.9 | 21.3 | 22.5 |
| PtIP-65Hd | — | — | 51.4 | 52.6 | 22.3 | 22.9 | 22.0 | 24.2 |
| PtIP-65He | — | — | — | 81.7 | 23.4 | 23.7 | 23.6 | 24.0 |
| PtIP-65Hf | — | — | — | — | 24.0 | 22.1 | 23.8 | 26.1 |
| PtIP-65Hg | — | — | — | — | — | 40.1 | 27.0 | 29.9 |
| PtIP-65Hh | — | — | — | — | — | — | 29.1 | 28.3 |
| PtIP-65Hj | — | — | — | — | — | — | — | 29.3 |
| PtIP-65Hk | — | — | — | — | — | — | — | — |

Example 4: Transient Expression and Insect Bioassay on Transient Leaf Tissues

To confirm activity of PtIP-50Aa (SEQ ID NO: 71) and PtIP-65Aa (SEQ ID NO: 22) as working together as a complex, both were cloned into a transient expression system under control of a viral promoter dMMV and AtUBQ10 respectively (Day, et. al., (1999) Plant Mol. Biol. 40:771-782; Norris S R et al (1993) Plant Mol Biol. 21(5):895-906). PtIP-50Aa (SEQ ID NO: 71) and PtIP-65Aa (SEQ ID NO: 22) were infiltrated alone and co-infiltrated at a 1:1 ratio. The polynucleotide encoding PtIP-65Aa (SEQ ID NO: 1) was cloned as a C-terminal HA tagged fusion vector for detection purposes resulting in the polynucleotide of SEQ ID NO: 116 encoding the polypeptide PtIP-65Aa-2×HA tag (SEQ ID NO: 217). The agro-infiltration method of introducing an Agrobacterium cell suspension to plant cells of intact tissues so that reproducible infection and subsequent plant derived transgene expression may be measured or studied is well known in the art (Kapila, et. al., (1997) Plant Science 122:101-108). Briefly, the unifoliate stage of bush bean (common bean, Phaseolus vulgaris) or soybean (Glycine max), were agro-infiltrated with normalized bacterial cell cultures of test and control strains. Leaf discs were excised from each plantlet and infested with 2 neonates of Soy Bean Looper (SBL) (Pseudoplusia includens), Corn Earworm, (CEW) (Helicoverpa zea) or 4 neonates of European Corn Borer (ECB) (Ostrinia nubialis) alone. Leaf discs from a control was generated with Agrobacterium containing only a DsRed2 fluorescence marker (Clontech™, 1290 Terra Bella Ave. Mountain View, Calif. 94043) expression vector. Leaf discs from a non-infiltrated plant was run as a second control. The consumption of green leaf tissue were scored after two (CEW) or three (ECB, SBL) days after infestation and given scores of 0 to 9. Neither the PtIP-50Aa polypeptide (SEQ ID NO: 71) or the PtIP-65Aa-2×HA tagged polypeptide (SEQ ID NO: 217) alone showed insecticidal activity at the concentrations tested, however insecticidal activity was observed when the expression vectors for both proteins were co-infiltrated (Table 12). The transiently co-expressed PtIP-50Aa polypeptide (SEQ ID NO: 71) and PtIP-65Aa-2×HA tag polypeptide (SEQ ID NO: 217) protected leaf discs from consumption by the infested insects while total green tissue consumption was observed for the negative control and untreated tissue. Transient protein expression of both PtIP-50Aa (SEQ ID NO: 71) and PtIP-65Aa-2×HA tagged (SEQ ID NO: 217) was confirmed by mass spectrometry-based protein identification method using trypsinized protein extracts of infiltrated leaf tissues (Patterson, (1998) 10(22):1-24, Current Protocol in Molecular Biology published by John Wiley & Son Inc) and by Western Analysis of the HA tag. These proteins were also active when run as a molecular stack in the bush bean transient assay system.

Experiments were run to test various tagged versions of both PtIP-50Aa (PtIP50Aa-GAAEPEA tag SEQ ID NO: 207; MBP-rTEV-PtIP50Aa SEQ ID NO: 219) and PtIP-65Aa (PtIP065Aa-GAAEPEA tag SEQ ID NO: 213; PtIP65Aa-rTEV-2×HA tag SEQ ID NO: 215; 2×HA tag-PtIP65Aa SEQ ID NO: 209; 10 HIS-MBP-rTEV-PtIP65Aa SEQ ID NO: 221) which showed that tagged versions of both proteins are still active and similar to untagged protein.

TABLE 12

| Construct | Insect | Avg. | StdDEV |
|---|---|---|---|
| PtIP-50Aa (SEQ ID NO: 71) + PtIP-65Aa-2XHA tag (SEQ ID NO: 217) (1:1) | SBL | 9 | 0 |
| pVER | SBL | 2.8 | 2.3 |
| blank | SBL | 1 | 0 |
| PtIP-50Aa (SEQ ID NO: 71) + PtIP-65Aa-2XHA tag (SEQ ID NO: 217) (1:1) | CEW | 9 | 0 |
| pVER | CEW | 1 | 0 |
| blank | CEW | 1 | 0 |
| PtIP-50Aa (SEQ ID NO: 71) + PtIP-65Aa-2XHA tag (SEQ ID NO: 217) (1:1) | ECB | 5.8 | 1 |
| pVER | ECB | 1.4 | 1 |
| blank | ECB | 1.4 | 1 |

| Value | Description |
|---|---|
| 1 | leaf disk is greater than 90% consumed |
| 2 | leaf disk is 70-80% consumed |
| 3 | leaf disk is 60-70% consumed |
| 4 | leaf disk is 50-60% consumed |
| 5 | leaf disk is 40-50% consumed |
| 6 | leaf disk is less than 30% consumed |

TABLE 12-continued

| | |
|---|---|
| 7 | leaf disk is less than 10% consumed |
| 8 | leaf disk has only a few pinholes |
| 9 | leaf disk is untouched by the insect |

Example 5: Lepidoptera Assays with Purified Proteins Transiently Expressed in Bush Bean Assay Insecticidal activity bioassay screens were conducted with C-terminally HA tagged PtIP-65Aa-rTEV-2×HA (SEQ ID NO: 215), and PtIP-50Aa (SEQ ID NO: 71) that were co-infiltrated into the bush bean transient system described above. The protein was purified from homogenized plant tissue using affinity beads targeting the 2×HA tag (Sigma-Aldrich A2095 Monoclonal Anti-HA-Agarose). The protein was tested in diet assay to evaluate the insecticidal protein effects on larvae of a diversity of Lepidoptera.

Lepidoptera feeding assays were conducted on an artificial diet containing PtIP-50Aa protein (SEQ ID NO: 71) and PtIP-65Aa-rTEV-2×HA (SEQ ID NO: 215) from 1:1 infiltrated Bush Bean. The PtIP-50Aa (SEQ ID NO: 71) and PtIP-65Aa-rTEV-2×HA (SEQ ID NO: 215) insecticidal proteins were tested for activity against Soy Bean Looper (SBL) (*Pseudoplusia includens*), Corn Earworm, (CEW) (*Helicoverpa zea*) and European Corn Borer (ECB) (*Ostrinia nubialis*). For SBL, the proteins were incorporated into a Lepidopteran-specific artificial diet (Southland Products) wells at a rate of 0, 0.06 ppm, 0.2 ppm, 0.63 ppm, 2 ppm, 6.3 ppm and 20 ppm. For CEW, the proteins were incorporated into a Lepidopteran-specific artificial diet (Southland Products) wells at a rate of 0, 0.16 ppm, 0.5 ppm, 1.58 ppm, 5.0 ppm, 15.8 ppm and 50 ppm. For ECB, the proteins were incorporated into a Lepidopteran-specific artificial diet (Southland Products) wells at a rate of 0, 0.38 ppm, 1.2 ppm, 3.8 ppm, 12.0 ppm, 38 ppm and 120 ppm. Neonate (2-3) larvae were placed in each well to feed for four days. Each bioassay was run with 4 duplicates at each dose. Results were expressed as positive for larvae reactions such as stunting and or mortality. Results were expressed as negative if the larvae were similar to the negative control that was fed diet to which the above buffer only has been applied. Larvae that had a size similar to controls were assigned a score of 0, those that showed slight stunting were scored 1, those that showed severe stunting were scored 2 and those that were dead were scored 3. The insecticidal activity of PtIP-50Aa (SEQ ID NO: 71) and PtIP-65Aa-rTEV-2×HA (SEQ ID NO: 215) combined in the Soy Bean Looper (SBL) (*Pseudoplusia includens*), Corn Earworm, (CEW) (*Helicoverpa zea*) and European Corn Borer (ECB) (*Ostrinia nubialis*) is shown in Table 13. Table 13 shows the LC50 based on the concentration (ppm) of PtIP-50Aa (SEQ ID NO: 71).

TABLE 13

| Insect | | PtIP-50Aa (SEQ ID NO: 71) ppm | Lower 95% CL | Upper 95% CL |
|---|---|---|---|---|
| CEW | LC50 | 16.73 | 12.50 | 23.18 |
| ECB | LC50 | >120 | | |
| SBL | LC50 | 0.9196 | 0.3099 | 2.578 |

Example 6: Co-Infiltration of PtIP-50 Polypeptides and PtIP-65 Polypeptides Cloned from Different Genera of Ferns Exhibit Activity Polynucleotides encoding PtIP-50 polypeptide homologs and PtIP-65 polypeptide homologs were identified from several species of ferns as shown in Example 3 and some were cloned into the transient expression vector as described in Example 2 above. Polynucleotides encoding the homologs were cloned from one of three ferns, *Asplenium australasicum*, *Polypodium musifolium* and *Adiantum pedatum* (Table 14.) Each homolog was co-infiltrated 1:1 in the bush bean transient system in a mix and match experiment to determine activity and spectrum from each combination. Results from various combinations in the mix and match experiment show that PtIP-50 polypeptides and PtIP-65 polypeptides from different sources of ferns can have activity with each other (Table 15.) The spectrum of activity is broadened with the improvement in FAW activity with PtIP-65Ha (SEQ ID NO: 25).

TABLE 14

| Fern | PtIP-50 Homolog | PtIP-65 Homolog |
|---|---|---|
| *Asplenium australasicum* | PtIP-50Aa (SEQ ID NO: 43) | PtIP-65Aa (SEQ ID NO: 1) |
| *Polypodium musifolium* | PtIP-50Ba (SEQ ID NO: 49) | PtIP-65Ba (SEQ ID NO: 3) PtIP-65Ha (SEQ ID NO: 4) |
| *Adiantum pedatum* | PtIP-50Bb (SEQ ID NO: 56) | PtIP-65Ca (SEQ ID NO: 8) |

TABLE 15

| PtIP-50 polypeptide | PtIP-65 polypeptide | bushbean transient activity | | | |
|---|---|---|---|---|---|
| | | CEW | ECB | FAW | SBL |
| PtIP-50Aa (SEQ ID NO: 71) | PtIP-65Aa (SEQ ID NO: 22) | 8.3 | 6.3 | 1.6 | 8.9 |
| PtIP-50Aa (SEQ ID NO: 71) | PtIP-65Ba (SEQ ID NO: 24) | 8.5 | 1.3 | 1.8 | 6.9 |
| PtIP-50Aa (SEQ ID NO: 71) | PtIP-65Ca (SEQ ID NO: 29) | 8.0 | 8.4 | 1.6 | 9.0 |
| PtIP-50Aa (SEQ ID NO: 71) | PtIP-65Ha (SEQ ID NO: 25) | 5.8 | 1.2 | 1.0 | 8.5 |
| PtIP-50Ba (SEQ ID NO: 77) | PtIP-65Ba (SEQ ID NO: 24) | 8.8 | 1.6 | 1.0 | 6.3 |
| PtIP-50Bb (SEQ ID NO: 84) | PtIP-65Aa (SEQ ID NO: 22) | 8.4 | 6.4 | 1.0 | 9.0 |
| PtIP-50Bb (SEQ ID NO: 84) | PtIP-65Ba (SEQ ID NO: 24) | 8.3 | 2.2 | 1.0 | 5.3 |
| PtIP-50Bb (SEQ ID NO: 84) | PtIP-65Ca (SEQ ID NO: 29) | 8.4 | 9.0 | 1.0 | 9.0 |
| PtIP-50Ga (SEQ ID NO: 88) | PtIP-65Hb (SEQ ID NO: 31) | 6.8 | 7.8 | 1.8 | 8.0 |

Example 7: Baculovirus Expression of PtIP-50Aa and PtIP-65Aa Polypeptides

The gene encoding PtIP-50Aa (SEQ ID NO: 71) was synthesized and subcloned into a pFastBac™ Dual vector (Invitrogen®) with the PtIP-50Aa native stop codon (TAA) (SEQ ID NO: 100). The gene encoding PtIP-65Aa-10×His (SEQ ID NO: 223) was subcloned with the stop codon removed for C-terminal translation of a 10×-histidine tag addition and the gene sequence of the histidine-tagged PtIP-65Aa is set forth as SEQ ID NO: 122. This vector was transformed into DH10Bac cells to generate baculovirus. These baculovirus were used to infect sf9 insect cells and incubated for 72 hours at 27° C. The infected insect cells were harvested by centrifugation. The cell culture pellet was suspended with 200 ml of lysis buffer (1×PBS, 10% glycerol, with protease inhibitor and benzonase) and incubated at 4° C. for 5 min with stirring, then homogenizing twice.

Chaps was added to lysate to a 1.0% final concentration and this was stirred at 4° C. for 1 hour. The lysate was centrifuged at 16000 rpm for 20 min. The supernatant was saved and loaded onto six 2 ml Ni-NTA columns pre-equilibrated with Elute buffer (1×PBS, 10% glycerol). The columns were then eluted with 10 ml of Elute buffer consisting of 10, 20, 50, and 250 mM of imidazole. Samples were analyzed by SDS-PAGE. The fraction from the 250 mM imidazole elution were concentrated to 5 mL and loaded onto two PD-10 desalting columns (GE Life Sciences, Pittsburgh, USA) pre-equilibrated with Elute buffer. 3 mL of Elute buffer was loaded on to each column and 2.5 mL of eluate collected from each column. The eluates from two desalting columns were combined. Lysates were assayed against SBL and CEW and were active when both PtIP-65Aa-10×His (SEQ ID NO: 223) and PtIP-50Aa (SEQ ID NO: 71) were present (Table 16).

TABLE 16

| Protein & expression | Insect | LC/IC | LC/IC50 ppm (4 d) | Lower 95% CL | Upper 95% CL |
|---|---|---|---|---|---|
| PtIP-50Aa (SEQ ID NO: 71)/ 65Aa-10XHis (SEQ ID NO: 223) | CEW | LC50 | >100 | | |
| | | IC50 | 22.24 | 12.56 | 47.10 |
| | SBL | LC50 | 1.157 | 0.7220 | 1.811 |
| | | IC50 | 0.2992 | 0.1974 | 0.4297 |

Example 8: *Agrobacterium*-Mediated Transformation of Maize and Regeneration of Transgenic Plants For *Agrobacterium*-mediated transformation of maize with PtIP-65 and PtIP-50 nucleotide sequences such as PtIP-50Aa (SEQ ID NO: 43) and PtIP-65Aa (SEQ ID NO: 1), the method of Zhao can be used (U.S. Pat. No. 5,981,840 and PCT Patent Publication Number WO 1998/32326; the contents of which are hereby incorporated by reference). Briefly, immature embryos are isolated from maize and the embryos contacted with a suspension of *Agrobacterium* under conditions whereby the bacteria are capable of transferring the nucleotide sequence (PtIP-50Aa SEQ ID NO: 43, PtIP-65Aa SEQ ID NO: 1) to at least one cell of at least one of the immature embryos (step 1: the infection step). In this step the immature embryos can be immersed in an *Agrobacterium* suspension for the initiation of inoculation. The embryos are co-cultured for a time with the *Agrobacterium* (step 2: the co-cultivation step). The immature embryos can be cultured on solid medium following the infection step. Following this co-cultivation period an optional "resting" step is contemplated. In this resting step, the embryos are incubated in the presence of at least one antibiotic known to inhibit the growth of *Agrobacterium* without the addition of a selective agent for plant transformation (step 3: resting step). The immature embryos can be cultured on solid medium with antibiotic, but without a selecting agent, for elimination of *Agrobacterium* and for a resting phase for the infected cells. Next, inoculated embryos are cultured on medium containing a selective agent and growing transformed callus is recovered (step 4: the selection step). The immature embryos are cultured on solid medium with a selective agent resulting in the selective growth of transformed cells. The callus is then regenerated into plants (step 5: the regeneration step), and calli grown on selective medium can be cultured on solid medium to regenerate the plants.

Example 9: Transformation and Regeneration of Soybean (*Glycine max*)

Transgenic soybean lines are generated by the method of particle gun bombardment (Klein et al., Nature (London) 327:70-73 (1987); U.S. Pat. No. 4,945,050) using a BIO-RAD Biolistic PDS1000/He instrument and either plasmid or fragment DNA. The following stock solutions and media are used for transformation and regeneration of soybean plants:
Stock Solutions:
Sulfate 100× Stock:
  37.0 g $MgSO_4.7H_2O$, 1.69 g $MnSO_4.H_2O$, 0.86 g $ZnSO_4.7H_2O$, 0.0025 g $CuSO_4.5H_2O$
Halides 100× Stock:
  30.0 g $CaCl_2.2H_2O$, 0.083 g KI, 0.0025 g $CoCl_2.6H_2O$
P, B, Mo 100× Stock:
  18.5 g $KH_2PO_4$, 0.62 g $H_3BO_3$, 0.025 g $Na_2MoO_4.2H_2O$
Fe EDTA 100× Stock:
  3.724 g $Na_2EDTA$, 2.784 g $FeSO_4.7H_2O$
2,4-D Stock:
  10 mg/mL Vitamin
B5 vitamins, 1000× Stock:
  100.0 g myo-inositol, 1.0 g nicotinic acid, 1.0 g pyridoxine HCl, 10 g thiamine.HCL.
Media (Per Liter):
S13199 Solid Medium:
  1 package MS salts (Gibco/BRL Cat. No. 11117-066), 1 mL B5 vitamins 1000× stock, 30 g Sucrose, 4 ml 2, 4-D (40 mg/L final concentration), pH 7.0, 2 gm Gelrite
SB1 Solid Medium:
  1 package MS salts (Gibco/BRL Cat. No. 11117-066), 1 mL B5 vitamins 1000× stock, 31.5 g Glucose, 2 mL 2, 4-D (20 mg/L final concentration), pH 5.7, 8 g TC agar
SB196:
  10 mL of each of the above stock solutions 1-4, 1 mL B5 Vitamin stock, 0.463 g (NH4)2 SO4, 2.83 g KNO3, 1 mL 2, 4 D stock, 1 g asparagine, 10 g Sucrose, pH 5.7
SB71-4:
  Gamborg's B5 salts, 20 g sucrose, 5 g TC agar, pH 5.7.
S13103:
  1 pk. Murashige & Skoog salts mixture, 1 mL B5 Vitamin stock, 750 mg MgCl2 hexahydrate, 60 g maltose, 2 g gelrite, pH 5.7.
SB166:
  SB103 supplemented with 5 g per liter activated charcoal.
Soybean Embryogenic Suspension Culture Initiation:
  Pods with immature seeds from available soybean plants 45-55 days after planting are picked, removed from their shells and placed into a sterilized magenta box. The soybean seeds are sterilized by shaking them for 15 min in a 5% Clorox® solution with 1 drop of Ivory™ soap (i.e., 95 mL of autoclaved distilled water plus 5 mL Clorox® and 1 drop of soap, mixed well). Seeds are rinsed using 2 L sterile distilled water and those less than 3 mm are placed on individual microscope slides. The small end of the seed is cut and the cotyledons pressed out of the seed coat. Cotyledons are transferred to plates containing SB199 medium (25-30 cotyledons per plate) for 2 weeks, then transferred to SB1 for 2-4 weeks. Plates are wrapped with fiber tape. After this time, secondary embryos are cut and placed into SB196 liquid medium for 7 days.
Culture Conditions:
  Soybean embryogenic suspension cultures (cv. 93Y21) were maintained in 50 mL liquid medium SB196 on a rotary shaker, 100-150 rpm, 26° C. on 16:8 h day/night photoperiod at light intensity of 80-100 pE/m2/s. Cultures are subcultured every 7-14 days by inoculating up to ½ dime size quantity of tissue (clumps bulked together) into 50 mL of fresh liquid SB196.

Preparation of DNA for Bombardment:

In particle gun bombardment procedures it is possible to use purified 1) entire plasmid DNA; or 2) DNA fragments containing only the recombinant DNA expression cassette(s) of interest. For every seventeen bombardment transformations, 85 µL of suspension is prepared containing 1 to 90 picograms (pg) of plasmid DNA per base pair of each DNA plasmid. DNA plasmids or fragments are co-precipitated onto gold particles as follows. The DNAs in suspension are added to 50 µL of a 10-60 mg/mL 0.6 µm gold particle suspension and then combined with 50 µL $CaCl_2$ (2.5 M) and 20 µL spermidine (0.1 M). The mixture is vortexed for 5 sec, spun in a microfuge for 5 sec, and the supernatant removed. The DNA-coated particles are then washed once with 150 µL of 100% ethanol, vortexed and spun in a microfuge again, then resuspended in 85 µL of anhydrous ethanol. Five µL of the DNA-coated gold particles are then loaded on each macrocarrier disk.

Tissue Preparation and Bombardment with DNA:

Approximately 100 mg of two-week-old suspension culture is placed in an empty 60 mm×15 mm petri plate and the residual liquid removed from the tissue using a pipette. The tissue is placed about 3.5 inches away from the retaining screen and each plate of tissue is bombarded once. Membrane rupture pressure is set at 650 psi and the chamber is evacuated to 28 inches of Hg. Following bombardment, the tissue from each plate is divided between two flasks, placed back into liquid media, and cultured as described above.

Selection of Transformed Embryos and Plant Regeneration:

After bombardment, tissue from each bombarded plate is divided and placed into two flasks of SB196 liquid culture maintenance medium per plate of bombarded tissue. Seven days post bombardment, the liquid medium in each flask is replaced with fresh SB196 culture maintenance medium supplemented with 100 ng/ml selective agent (selection medium). For selection of transformed soybean cells the selective agent used can be a sulfonylurea (SU) compound with the chemical name, 2-chloro-N-((4-methoxy-6 methy-1,3,5-triazine-2-yl)aminocarbonyl) benzenesulfonamide (common names: DPX-W4189 and chlorsulfuron). Chlorsulfuron is the active ingredient in the DuPont sulfonylurea herbicide, GLEAN®. The selection medium containing SU is replaced every two weeks for 8 weeks. After the 8 week selection period, islands of green, transformed tissue are observed growing from untransformed, necrotic embryogenic clusters. These putative transgenic events are isolated and kept in SB196 liquid medium with SU at 100 ng/ml for another 5 weeks with media changes every 1-2 weeks to generate new, clonally propagated, transformed embryogenic suspension cultures. Embryos spend a total of around 13 weeks in contact with SU. Suspension cultures are subcultured and maintained as clusters of immature embryos and also regenerated into whole plants by maturation and germination of individual somatic embryos.

Somatic embryos became suitable for germination after four weeks on maturation medium (1 week on SB166 followed by 3 weeks on SB103). They are then removed from the maturation medium and dried in empty petri dishes for up to seven days. The dried embryos are then planted in SB71-4 medium where they are allowed to germinate under the same light and temperature conditions as described above. Germinated embryos are transferred to potting medium and grown to maturity for seed production.

Leaf disc were excised from the transformed plants and tested for insecticidal activity of PtIP-50 and PtIP-65 against the Soy Bean Looper (SBL) (*Pseudoplusia includens*), Corn Earworm, (CEW) (*Helicoverpa zea*), European Corn Borer (ECB) (*Ostrinia nubialis*) and Velvet Bean Caterpillar (VBC) (*Anticarsia gemmatalis*). The expected activity was observed for SBL, CEW and ECB, however activity was recorded in assay against VBC as well (Table 17).

TABLE 17

| Event | DNA | VBC 3rd avg. score | SBL 3rd avg. score | SBL NEO avg. score | CEW NEO avg. score | FAW NEO avg. score | VBC 1st avg. score | ECB NEO avg. score |
|---|---|---|---|---|---|---|---|---|
| SOY 1985.3.1 | PHP61857A | 5.5 | 8.0 | 8.3 | 8.0 | 1.0 | 8.0 | 8.7 |
| SOY 1987.2.1 | PHP61857A | 4.5 | 8.0 | 8.8 | 8.3 | 1.0 | | |

Example 10: Mode of Action

PtIP-50 polypeptides and PtIP-65 polypeptides were evaluated for stability in the presence of midgut fluid extracts from *Pseudoplusia includens* to determine if their full length states represent pro-forms of the proteins and whether midgut proteolysis is required for activation to a toxic state in vivo.

Figure 18:
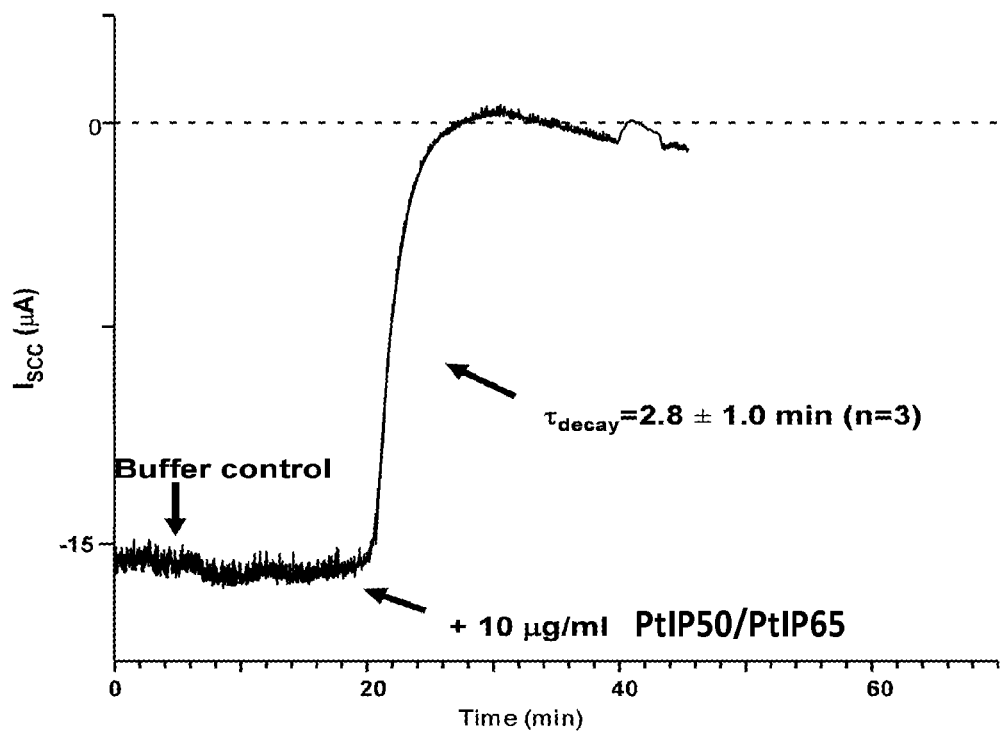
FIG. 18 shows the effect of the PtIP-50Aa (SEQ ID NO: 71) and PtIP-65Aa (SEQ ID NO: 22) polypeptides on isolated *Anacarsia gemmatalis* midgut activity. $I_{SCC}$ reflects the transport activity and midgut structural integrity to maintain normal midgut function. The decline in $I_{SCC}$ following the addition of PtIP-50/65 polypeptides reflects the loss of ionic balance in the midgut.

The ability of the mixture of a PtIP-50 polypeptide and a PtIP-65 polypeptide to alter short circuit current (SCC) in isolated midguts from the Lepidoptera, *Anacarsia gemmatalis* was evaluated. Effects on the SCC in this system is considered consistent with pore formation, ion channel interaction, electrogenic transporter interaction, or possibly disruption of tight junctions that maintain diffusional barriers between midgut cells. An example of the effects of the mixture of the PtIP-50Aa (SEQ ID NO: 71) and PtIP-65Aa (SEQ ID NO: 22) polypeptides on SCC is shown in FIG. 18. The ISCC reflects the transport activity and midgut structural integrity to maintain normal midgut function. The decline in ISCC following the addition of PtIP-50Aa (SEQ ID NO: 71) and PtIP-65Aa (SEQ ID NO: 22) polypeptides reflects the loss of ionic balance in the midgut.

Figure 20A:
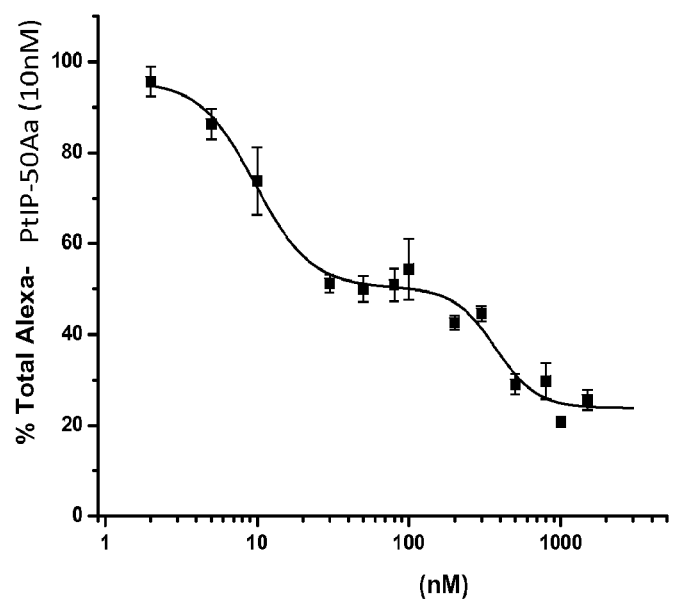
FIGS. 20a and 20b show the evaluation of $EC_{50}$ values from densitometry of gel images for PtIP-50Aa (SEQ ID NO: 71) and PtIP-65Aa (SEQ ID NO: 22) binding to *C. includens* BBMVs.
Figure 20B:
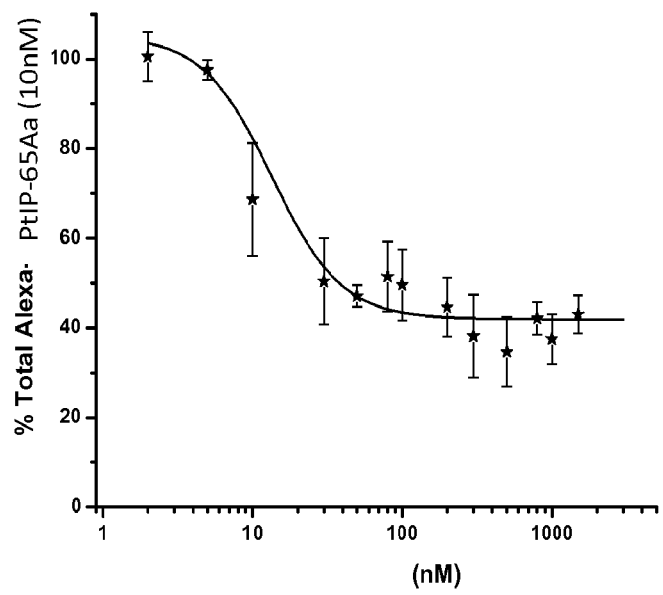

The direct binding of the PtIP-50Aa (SEQ ID NO: 71) and PtIP-65Aa (SEQ ID NO: 22) polypeptides to *Pseudoplusia includens* brush border membrane vesicles was tested for target site identification. Specific binding, demonstrates the presence of a receptor for this binary. Heterologous competition with other insect-active toxins was tested to evaluate the competitive binding to the target site. Specific binding of PtIP-50Aa (SEQ ID NO: 71) and PtIP-65Aa (SEQ ID NO: 22) is illustrated in FIGS. 19 and 20*a* and 20*b*. Specific binding, demonstrates the presence of a receptor for this binary. Heterologous competition with other insect-active toxins was tested to evaluate the competitive binding to the target site. Specific binding of PtIP-50Aa (SEQ ID NO: 71) and PtIP-65Aa (SEQ ID NO: 22) is illustrated in FIGS. 19, 20*a* and 20*b*. FIG. 19 shows a gel image of the specific binding of PtIP-50Aa (SEQ ID NO: 71) and PtIP-65Aa (SEQ ID NO: 22) to BBMVs from *C. includens*. As the concentration of unlabeled PtIP-50Aa (SEQ ID NO: 71) and PtIP-65Aa (SEQ ID NO: 22) is increased, the likelihood that Alexa-labeled PtIP-50Aa (SEQ ID NO: 71) and PtIP-65Aa (SEQ ID NO: 22) can bind to the target receptor is decreased. The concentration at which the fluorescence signal from bound Alexa-PtIP-50Aa (SEQ ID NO: 71) and PtIP-65Aa (SEQ ID NO: 22) is reduced to 50% when compared to the signal measured in the absence of unlabeled PtIP-50Aa (SEQ ID NO: 71) and PtIP-65Aa (SEQ ID NO: 22) reflects the point at which half (50%) of the total receptors are occupied by unlabeled PtIP-50Aa (SEQ ID NO: 71) and PtIP-65Aa (SEQ ID NO: 22) and is referred to as the EC50 concentration. Densitometry results and EC50 determinations from the average three replicates are shown in FIGS. 20a and 20b. FIGS. 20a and 20b show the evaluation of EC50 values from densitometry of gel images for PtIP-50Aa (SEQ ID NO: 71) and PtIP-65Aa (SEQ ID NO: 22) binding to C. includens BBMVs. FIG. 20a shows the average densitometry values for bound Alexa-PtIP-50Aa (SEQ ID NO: 71) in the presence of different concentrations of unlabeled PtIP-50Aa (SEQ ID NO: 71) and PtIP-65Aa (SEQ ID NO: 22) normalized to the amount bound in the absence of unlabeled PtIP-50Aa (SEQ ID NO: 71) and PtIP-65Aa (SEQ ID NO: 22). The solid line reflects the best fit of a square logistic equation to the data. The data are best fit by a two-component equation having EC50 values of 10 nM and 370 nM for the high affinity and low affinity components, respectively. FIG. 20b shows the average densitometry values for bound Alexa-PtIP-65Aa (SEQ ID NO: 22) in the presence of different concentrations of unlabeled PtIP-50Aa (SEQ ID NO: 71) and PtIP-65Aa (SEQ ID NO: 22) normalized to the amount bound in the absence of unlabeled PtIP-50Aa (SEQ ID NO: 71) and PtIP-65Aa (SEQ ID NO: 22). The EC50 value from the fit is 14 nM.

Example 11: PtIP-50 & PtIP-65 Fusion Proteins

Fusion protein(s) of PtIP-50Aa and PtIP-65Aa (SEQ ID NO: 71 and SEQ ID NO: 22) Constructs on Excel Sheet) were created with a small synthetic linker between the two proteins and cloned into the Bush Bean transient system.

Two fusion proteins were made with PtIP-50Aa either N-terminal or C-terminal to PtIP-65Aa. After infiltration of bush bean leaf discs were infested with either CEW, ECB or SBL and assayed for 3 (CEW) or 4 (SBL, ECB) days. The results of the assay show that the fusion protein did protect the leaf discs from consumption and are a viable control option (Table 18).

TABLE 18

| Fusion | |
|---|---|
| PtIP-65Aa/PtIP-50Aa | SBL (9.0)<br>CEW (7.2) |
| PtIP-50Aa/PtIP-65Aa | SBL (8.8)<br>CEW (8.7)<br>ECB (6.1) |

Example 12—Particle Bombardment Transformation and Regeneration of Transgenic Plants Immature maize embryos from greenhouse donor plants are bombarded with a plasmid containing a nucleotide sequence encoding the insecticidal protein. The ears are husked and surface sterilized in 30% Clorox® bleach plus 0.5% Micro detergent for 20 minutes and rinsed two times with sterile water. The immature embryos are excised and placed embryo axis side down (scutellum side up), 25 embryos per plate, on 560Y medium for 4 hours and then aligned within the 2.5 cm target zone in preparation for bombardment. A plasmid vector DNA comprising the nucleotide sequence encoding the insecticidal protein operably linked to a promoter is precipitated onto 1.1 μm (average diameter) tungsten pellets using a $CaCl_2$ precipitation procedure as follows: 100 μl prepared tungsten particles in water; 10 μl (1 μg) DNA in Tris EDTA buffer (1 μg total DNA); 100 μl 2.5 M $CaCl_2$ and 10 μl 0.1 M spermidine.

Each reagent is added sequentially to the tungsten particle suspension, while maintained on the multitube vortexer. The final mixture is sonicated briefly and allowed to incubate under constant vortexing for 10 minutes. After the precipitation period, the tubes are centrifuged briefly, liquid removed, washed with 500 ml 100% ethanol and centrifuged for 30 seconds. Again the liquid is removed, and 105 μl 100% ethanol is added to the final tungsten particle pellet. For particle gun bombardment, the tungsten/DNA particles are briefly sonicated and 10 μl spotted onto the center of each macrocarrier and allowed to dry about 2 minutes before bombardment. The sample plates are bombarded at level #4 in a particle gun. All samples receive a single shot at 650 PSI, with a total of ten aliquots taken from each tube of prepared particles/DNA Following bombardment, the embryos are kept on 560Y medium for 2 days, then transferred to 560R selection medium containing 3 mg/liter Bialaphos, and subcultured every 2 weeks. After approximately 10 weeks of selection, selection-resistant callus clones are transferred to 288J medium to initiate plant regeneration. Following somatic embryo maturation (2-4 weeks), well-developed somatic embryos are transferred to medium for germination and transferred to the lighted culture room. Approximately 7-10 days later, developing plantlets are transferred to 272V hormone-free medium in tubes for 7-10 days until plantlets are well established. Plants are then transferred to inserts in flats (equivalent to 2.5" pot) containing potting soil and grown for 1 week in a growth chamber, subsequently grown an additional 1-2 weeks in the greenhouse, then transferred to classic 600 pots (1.6 gallon) and grown to maturity. Plants are monitored and scored for expression of a PtIP-50 polypeptide or a PtIP-65 polypeptide by assays known in the art, such as, for example, immunoassays and Western blotting.

Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number US 2003/0120054 and International Publication Number WO 2003/018810.

Bombardment medium (560Y) comprises 4.0 g/l N6 basal salts (SIGMA C-1416), 1.0 ml/l Eriksson's Vitamin Mix (1000.times.SIGMA-1511), 0.5 mg/l thiamine HCl, 120.0 g/l sucrose, 1.0 mg/l 2,4-D and 2.88 g/l L-proline (brought to volume with D-I $H_2O$ following adjustment to pH 5.8 with KOH); 2.0 g/l Gelrite (added after bringing to volume with D-I $H_2O$) and 8.5 mg/l silver nitrate (added after sterilizing the medium and cooling to room temperature). Selection medium (560R) comprises 4.0 g/l N6 basal salts (SIGMA C-1416), 1.0 ml/l Eriksson's Vitamin Mix (1000.times.SIGMA-1511), 0.5 mg/l thiamine HCl, 30.0 g/l sucrose and 2.0 mg/l 2,4-D (brought to volume with D-I $H_2O$ following adjustment to pH 5.8 with KOH); 3.0 g/l Gelrite (added after bringing to volume with D-I $H_2O$) and 0.85 mg/l silver nitrate and 3.0 mg/l bialaphos (both added after sterilizing the medium and cooling to room temperature).

Plant regeneration medium (288J) comprises 4.3 g/l MS salts (GIBCO 11117-074), 5.0 ml/l MS vitamins stock solution (0.100 g nicotinic acid, 0.02 g/l thiamine HCL, 0.10 g/l pyridoxine HCL, and 0.40 g/l glycine brought to volume with polished D-I $H_2O$) (Murashige and Skoog, (1962) *Physiol. Plant.* 15:473), 100 mg/l myo-inositol, 0.5 mg/l zeatin, 60 g/l sucrose and 1.0 ml/l of 0.1 mM abscisic acid (brought to volume with polished D-I $H_2O$ after adjusting to pH 5.6); 3.0 g/l Gelrite (added after bringing to volume with D-I $H_2O$) and 1.0 mg/l indoleacetic acid and 3.0 mg/l bialaphos (added after sterilizing the medium and cooling to 60° C.). Hormone-free medium (272V) comprises 4.3 g/l MS salts (GIBCO 11117-074), 5.0 ml/l MS vitamins stock solution (0.100 g/l nicotinic acid, 0.02 g/l thiamine HCL, 0.10 g/l pyridoxine HCL and 0.40 g/l glycine brought to volume with polished D-I $H_2O$), 0.1 g/l myo-inositol and 40.0 g/l sucrose (brought to volume with polished D-I $H_2O$ after adjusting pH to 5.6) and 6 g/l bacto-agar (added after bringing to volume with polished D-I $H_2O$), sterilized and cooled to 60° C.

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (326 sequences)

SEQ ID NO: 1 - DNA, 1020 bp, Asplenium australasicum
atggcgttggtgatcggtggcctcattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaatggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatagatgctctgggggtggtcttcttgcagcgcatacaaagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctcctcctcttcctctctcttactcccttggtcgcgcagtgggtccttgctcccttcaaaatccttcgccctttccgctctgccttatcgcggtaatgtcagtggcctctcctttaatggctcggcccgagtcactaccagcggtggcacgttctccttctccgggctgcaaggtagattcaccggccaaagctacgcgattgacatcaccactcagtag

SEQ ID NO: 2 - DNA, 1071 bp, Asplenium x kenzoi Sa. Kurata
atgagctccttaataaacccgcatttggaaacaattaggtatggagggtcttttgcagggggtagtccattcagaatcttaggcgagactgaggggagagtgctacaacgcatccggatatctcgcatggctaatgccatcgatgccatcgagttttggctcactggcgactccaccccaagagtctacggcactgtaaggtcggagaatagcagcttcgacttctctgagggcgagaggattacagggctccggtttcggaacgcattatttggtataggacagaatcaatggaatcacgtggcgcgagtatggttctccacaagcagagggaggacatttgaatacggctcaacaagggaaccgacagggcagtggtttgaagtgaatgtggggtcaggcgtttgtgtgggcgtggcgggaaatgtgatgctgaactctcttaacatgctaggctttgtatttctgaggagtatacaaagtgtggggttttcctctgtggagtatcctatgttcagtacctccatcaccagaacatccatcctggagcagctacccgacacatttaagagtaacgacgatgacgagccccttcaaatggtgttggctggcagtcgccaattcaagaccagctccacgtggagagtgtcgtcacctaccgtgggcttgctgtcccacctcactggtaacaatattctagtcgacgtcaccttgggtatcaacacccctactgtggtgcccaccggccttgcgggcgcgtccaccactttccaatgggaaacagtccgcgcctttccctccaccaatgcaatccagggttccatatccaatcttacagtctctaccgatgagtacagtgtctggtgccacatctccgataccgtagcccctgctcaatcgctcccgaaacacgctgcctgggtcggtgaaggtaggatcactgcactcccctgctccgccaacatccaagtgtttaccagtggagggaataacttcccatttggtaccttctcgtttccggtccgactcctctacgacggtggagctcactccaacgtgcaagtcctttga

SEQ ID NO: 3 - DNA, 1065 bp, Polypodium musifolium
atggcgttgtatcagacacccgtgtatgtcatcggagggcaaggtggcagctcgtttacttatgatcagagcagaaacgggaaggtgttgaggaagattggggtgtgggctggcgagtggcagctgcgcggcatccgggtatggatgtctggctccgatagcccggccaccttcggctcggcctctggctcttactctgagtatacatttgcggatggcgagcgcatcacccggttgtccttgtggggcaacggtgctggtacgcgttccggagcaattaggttctacacgacaaccggaggctcattttttccaaaaatgacatcttggggcctaaaaactgagtatccaatggatgtggcatccggtctttgtgtggggatcctaggacgagctaatgttgatgttgattcattggggttcttgtttctcagaaccatagcgtctgctcgcatgatcaatgtaagctacccaaccttgggattagagcaagctggaattatcccaatcacgcttgattcatacaatgactctaataatgcaggtgctatttccaagaattggactttctccggtagccgaacagttacaatatcatcatcatggacgcttactacggggatagaggctcatgctagtgtgactgttcaagcaggaatcccctctgttgctgaagtgagcggagagtttggatggtcagtgagtgtaaccggaagttacacaagcacccaagaggaaagtcgaaccctcacttggaaccaatctggaaccctagagccaggacaatggatttccatccaagctaccactcgaagaggaaccatcaccttgccttaccaggggaccatggagatcaccctacagtctggcactgtgtttcgatatcccatctcctctatgtattccggtgtggattatacgagtgttgacataactaacacaggaactagagcattgaagaatgaagttgaggttgaagctgttgatcagcaatcccaggaaggagatcacaatgtccaacccaataaggaagtccaagaaagcaaagtcctctttattgagtag

SEQ ID NO: 4 - DNA, 1065 bp, Polypodium musifolium; identical to SEQ ID NO: 3

SEQ ID NO: 5 - DNA, 1026 bp, Polypodium punctatum 'Serratum'
atggcgttggtgatcggtggcctgattggtgggggagggggctcctacttcagctactacgggggcacggacgggagggtaatgcagaggatcagggtgtgggcggcgacaagccggatcaaggccatctcggtgtggctgagcgacggtgtgcagagaacattcggggacccaagcaggccggcaggcgaaggaaacctgaggagtgcagagttcagcttcaacacgggggagcgcgtgacgcgtctgtccttgtggggcaatggcataggcacacgatcggggtggatatatttcgagacgaatcaggggcggaggttcgatttcggaatgtacagttgggggaagcagacagagttcccgcaaactgtagcatcgggcatctgggtgggcttcacagggagagcatcgcttgacgtggacgccttgggggtggtgttcctgcggccgatacaaagttgccaactcatgaacgttcaatacccgactctgcagttcagcgggagctcgggcgccacctccattacgcccacagcctcctccaccaagtccttcactctcctcaacacagcagatcatgaggatcaatccagtacccaacaactcgcctgggagctcgcggacgagccccgcttcgacaacgtctttctctcttggtccctctccaacccctctgccggcttgcttcaatttatcaccacctcctccatctctgttcaagctcgtacccccgctctcgctgtcgtcaacaatgttgtcggctggcagctcagtgcctccgatacccaatcctcttctctctcctcctcctcctctctctctctcccttggtctcgctctggctccttgcttccctctcagtccctcactaccctctctgctctcacttatcgcggtgatgcaaggaacctcttcttcaatggctctgcccaagtcaccactaccactggcagcaggttctcctttcccggcctccaaggactattcaccggccaaagctacgtacctgctatcaccagtcaatag

SEQ ID NO: 6 - DNA, 1065 bp, Polypodium punctatum 'Serratum'
atggcgttgtatcagacacccgtgtatgtcatcggagggcaaggtggcagctcgtttacttatgatcagagcaggaacgggagggtattgacgaagattggggtgtgggctggtgagtggcagctgcgcggcatccgggtatggatgtcgggctccgataccccggccacctttggctctgcctccggctcgtactctgagtatacatttgcggatggcgagcgcatcacccggttgtccttgtggggcaacggtgctggtacgcgttccggagcaattaggttctacacgacaaccggaggctcattttttccaaaaatgacatcttggggcttgcaaactgagtatccgatcgatgtggcatccggcctttgtgtggggatcctaggacgagctaatgttgatgttgattcattggggttcttgtttctcagaaccatagcatctgcgcgcatgatcaatgtaagctatccaaccttgggattagagcaagctggaattatcccaatcacgcttgattcgtacaacgactctaataatgcaggtgctatttccaagaattggactttctccggtagccgaacagttacaatatcatcgtcatggacgctcactacggggatagaggctcatgctagtgtgactgttcaagccggaatcccctccgttgctgaagtgagcggagagttcggatggtccgtgagtgtaaccggaagctacacaagcacccaagaggagagtcgaaccctcacttggaaccaatctggaaccctagagccaggacaatggatttccatccaagctaccactcgaagaggaaccatcaccttgccttaccaggggaccatggagatcaccctacagtctggcactgtgtttcgataccccatctcctctatgtattccggtgtggattatactagtgttgacataactaacacaggaactagagcattgaagaacgaagttgaggttgaagctgttgatcagcaatcccaggaaggagatcacaatgtccaacccaataaggaagtccaagaaagcaaactcctctttattgagtag

SEQ ID NO: 7 - DNA, 1077 bp, Polypodium punctatum 'Serratum'
atgagttcgttaataaacccgcatttggaatcgattacgtatgcagggtcttttgcagggggtagtcctttcagaatcttaggcgagactcaggggagagtgctacaacgcatccgggtatctcgcatagctacaagaatcgaagccatcgagttctggctcactggcgactccaccccaagggtctacggcactgtaaggtcggagaatagcagctacgacttcgctgagggcgagaggattacaaggctgcggtttcgaacctcaagatttggttttggagtacagactcaatgggatcacgtggcgcgggtatggttctccacaagcagagggaggacattcgaatacggctcaacaagggaaccgtcagggcagtggttcgaagcgaatgtcgggtcaggcgtgtgcgtgggtgtggcgggaaatgtgatgctggactctcttaacatgctaggctttgtgtttctgaggagtatacaaagggtggggttcacctctgtggagtatcccacgatcagtagctccatcgccagaacgttcatcctgtcgcacttgcccgacacgtttaagagtaacgacgatgacgagccccttcaaatggtgttggctggcagtcgccaattcaagacgacctccacgtggagagcgcagtcacctgctgtgggcctgctgtcccacctaactgctaacaatattacactcgacctcaccttgggtatcaacacccctactgtggtgcccaccggcactgcgggcgcatccaccgctttccaatggcagacagtccgcacctttccctccatcaatgcagaaatccagggtaccattgccaatcttacagtctctaccgctgagtacagtgtctggtgccatatctccgatacagtagcccctgctcagtcgatcccgaaacactctgcctgggttggtgaaggaaggatcactgcactgccctgctccgccaacatccaagtgattactagtggaggtaataacttaccatttgcaagcttctcgtttcctgtccgactcttttacgacggtggagctcactcgaccgtgcaagtgctttga

SEQ ID NO: 8 - DNA, 1026 bp, Adiantum pedatum; identical to SEQ ID NO: 5

SEQ ID NO: 9 - DNA, 1065 bp, Platycerium bifurcatum
atgtcgctggttcagacacccgtgtatgtcatcggagggcaaggaggcaatgcgttttcttacgatcagagcagaaacgggaggatcctgcggaggataggggtgtgggcgggcgagtggcaactgcgcggaatccgcgtgtggatgacgggcaccgacaccccggccacctttggcacggccacgggctcttatagtgaatataccttcacggatggcgagcgcatcacccgcttgtccctgtggggcaacggggctggtacacgttctggaggcattagattctacaccacaacaggaggttcttttttccataaaatgacatcttggggcttacagaccgagtatccaatcgatgtggcatctggtctttgtgtggggatcacgggacgagctaatgttgatgtggattcattgggtgttttgttcttaagaaccatagcacctgctcgtatgatcaatgtaagctaccctaccttgggcttagagcaagccggaatcatccctgttacccttgattcgtacaatgactccaacaatgcaggtactatttccaaaaattggactttctcgggtagccgaacagtgacaatatcatcatcatggtcgctcacttcagggatagagacacatgcaagtgtgagcgtgcaagcagggatccccatggttgcagaagtgagtggagagtttggatggtctgttagtgtatctgggacctatgcaaccactcaagaggaaagtcgaaccctaacttggaaccaatctggaaccctagagcctgggcaatggatctcactccaagctaccactcgaagaggaaccatcacattaccctttcaagcaaccatggaaatcactttgctgtctggaacgatctttcaatatgccatctcctctatgtactccggtgtggattatactagtgtggatataactaacactggaactagagcatcagatcatgttgaggtcgaagctactgagcaacaagtccaaggggtcaaagatcaaagtgtacaacctaataaagaagctaaggagtgcacactcctctttgctgaataa

SEQ ID NO: 10 - DNA, 1068 bp, Platycerium bifurcatum
atgagtttattgacgcctcatttgctaaccgcgtctgcaggcggttttatagggggtgatatatttagacactcaggcgagactgatgggagagtgctacaccgcatccggttatctcgagaggttgcacgcatctctgccgtcgagttttggctcacaggcaactccaccccatacgtctacggcactccaagggcggataatagcagctacgaattcgtcgacggcgagaggattacaaggctcgactttcggactcatttatttggtgttgtaacgatccaatgggacaatatagcgcgggtacgcttctccacaagcagagggaggatattcgaatttggctcaagcagggaaccgagcgggcagtggtttacagcgaatgtggggtcaggcgtgtgcgtgggcatgtcgggagtcgaggcgaatggcgctctgacaaggctaggctttatgtttctgaggagtattcagagcgtggggttttcctctgtggagtatcccacgctcagtacctccaccatcttgacaacgcccatcctggagcagttacccgacacgtttaagagtaacgacgatgacgagccccttcacgtggtgttggctggcagtcgccaattggagaccacctccacgtggacgtcacctgcggtaggcctgctctcccacctaactggtaacgatattacagtcaacgtcagcttgggtatcaacacccctactgtagtgcccagcggccctgagggcgcgtccaccactttccattggcagacagtccgcacctttccctcctccaatgcaatggaaggttccattgccaacctcaccgtcactaccaatgagtacagtgtttggtgccacatctccgacaccatagcccctgctcaattgctccccaaacacgttgccttggtcggcgaaggtaggattactgctctcccctgctccgccagaatccaagtgttaactagttcagcgtatgatttaccatttgctaccttctcgtttccggtccaatccctctacaacggtcgagcccactcgcaggtgcaaatcattgatccgtga

SEQ ID NO: 11 - DNA, 1083 bp, Nephrolepis falcata
atggccaatctgttaacaccgctgtatatgcaaccggttcagcttgccgggagtgttaatacgtccttgggtttgtggagagtgtcaagcgagactgaaggcaaggtgttaaaacgcattcgggtgtatcgcttaacccgatccatccctgccattgaggtttggctcacaggtgactccaacccacatgtgtgcggcactccaggccgcgcggagagtagcacctttgagttcagtgagggcgagcgcatcacaacacttgtgttgcaggatgcccagaacatccccacccatgtgggacgcatccgattccaaacgagcttgcttcggacgtttgaatacggcatgtcagtacagccaaccggaaaggtgactacagtcaatgtgggatccggcgtgtgcgtgggggtgcgggcatctcatagctcaacatatgggatcagtgtatttggctttatgtttctaaggccaatacagagcgtgaggcttcatggcttagtgtatcctacaatcagcagcacgtctaccattaccaccaccatcctgcaggagctacctgctactattaagaatgacaatgatcatgaaccccttcactgggtgctagctggaagtcgtcaatgtatcacgagctccacctggagaacgcagccggctgatcgtgagggcctggtgtcccacctagtgggtagagccatttccatcaatattgacttaggtattgacacccccaagattgtggccactggcggcactgcgggtgcatcgaccaatttcggttgggagactgcccgcacctttccttctacaaatgcagtagagggctccattgctgatctcaccgtcaggaccaatgaatacagtgtttggggccatgtctctgacaccttggcccctgctcaatctctcatcagcagacgtgctgttttgattggcgaaggcagtattgataatttgcagtgctccgctagaatccaggtcttcacagatgctgacggtggcttgccatttgctaccttcacatttccagtcggagttctttacagcgcccgtgcccactcagacgtccaagttttgagttaa

SEQ ID NO: 12 - DNA, 1071 bp, Nephrolepis falcate
atgaccagtctgttaacaccgccgtatatgcaacccattcagtctgccgggggtttgtttagctccttcatagtgtcgggcgagactgaaggcaaggtgttacaacgcattcgggtgtatcgcttctcccgaaacatcgctgccattgaggtttggctcacaggtgactccaacccacacttgtgcggtactccaggccgtgcggagagtagcacctttgaattcagcgagggcgagcgcatcacaacacttgagctgcaggaagacccgcaactcccttacactgttgtgggacgcatccgattccaaacgagccgacttcggacgtttgaatacggcatgtcagtacagccaagcgggcgggtgattacagtcaatgtgggatcgggcgtatgcgtgggggtgcgggcaggtaccgcattatcggtgatcagtattcttggctttatgtttctaaggccaatacggagcgtgaggcttcatggcttggtgtatcccacaatcagcagcatctctaccatcaccaccaccatcctgcaggagctacctgctactcttaagaatgacgatgatcatgaaccccttcactgggtgctagctggaagtcgtcaatgtttcacgagctccacctggagaacgcagctggcttatcgtgcgggcctggtgtcccacctagtgggtagtgccatttccatcaatatggacttgggtatcgacgcccccaagattgtggccactggcggcactgcgggtgcatccaccaatttcggttgggaaactgcccgcacctttccttctacaaatgcaatacagggctccattgctgatctcatcgtcagtaccaatgcatacagtgtttggggccatgtctcggacaccttagcccctgctcaatctctcatcagcagacgtgctgctttgattggtgaaggccgtatcgataatttgcagtgctctgctagaatccaggtcttcacaaatgacagtgccttgtcattagctaccttcacatttccagtcggagtcctttacagcgcccgtgcccactcagacgtgcaagtcttgagttaa

SEQ ID NO: 13 - DNA, 1065 bp, Ophioglossum pendulum
atgtcgctggttcagacacccgtgtatgtcatcggagggcaaggaggcaatgcgtttacttacgatcagagcagaaacgggaggatcctgcggaggattggggtgtgggcgggcgagtggcaactgcgcggaatccgcgtgtggatgacgggcaccgacaccccggccactttcggcacggccacgggctcttacagtgaatataccttcgcggatggcgagcgcatcacccgcttgtccttgtggggcaacggggctggtacacgttcaggaggcatcagattctacaccacaacaggaggttctttcttccataaaatgacatcttggggcttacaaaccgagtatccaatcgacgtggcatctggtctttgtgtggggatcatgggacgagctaatgttgatgtggattcattgggtgttttgttcttaagaaccatagcatctgctcgtatgatcaatgtaagctaccctaccttgggcttagagcaagccggaatcatccctgttacacttgattccttcaatgactccaacaatgcaggtactatttccaaaaattggactttctcgggtagccgaaccgtgacaatatcatcatcatggtctctcacttcagggatagagacacatgcaagtgtgagcgtgcaagcagggatccccatggttgcagaagtgagtggagagtttggatggtctgttagtgtatctgggacctatgcaaccactcaagaggaaagtcgaaccctaacttggaaccaatctggaaccctagagcctgggcaatggatctcactccaagctaccactcgaagaggaaccatcacattaccctttcaagcaaccatggaaatcactttgctgtctggaacgatctttcaatatgccatctcctctatgtactccggtgtggattatactagtgtggatataactaacactggaactagagcatcagatcatgttgaggtcgaagctactgagcaacaagtccaaggggtcaaagatcaaagtgtacaacctaataaagaagctaaagagtgcacactcctctttgctgaataa

SEQ ID NO: 14 - DNA, 1062 bp, Colysis wrightii 'Monstifera'
atggcgttgtatcagacacctgtgtatgtgatcggagggcaaggtggcaactcgtttacttacgatcagagcaggaacgggaaggtgttgacgaagattggggtgtgggctggcgagtggcagctgcgcggcatccgggtttggatgtctggctccgatagcccgaccacctttggcacagcctcgggctcttactctgaatacacatttgcagctggcgagcgcatcacccggttgtctttgtggggcaacggtgctggtacgcggtctggagccattagattctacacgacaactggaggctcatttttcccaaaaatgacatcttgggacttaaagactgagtatccaattgatgtggcatccggtctttgtgtggggatcataggacgagctagtgctgacattgattcattggggtttatgtttctcagaaccatagcatcttctcgcatgatcaatgtaagctacccaaccttgggcttagagcaagctggaattatccccgtcacgcttgattcgtacaacgactctaataatgcaggttctatttccaagaattggactttctctggtagccgaacagttacaatatcatcatcatggacactcacttcagggatagaggcacatgctagtgtgaccgttcaagcaggaatcccctcggttgcagaagtgagcggagagtttggatggtcagtgagtgtaagtggaagctacacaagcacccaagaggagagtcgaaccctcacttggaaccaatccggaaccctagagccaggacaatggatttccatccaagctaccactcggagaggaaccatcaccttgccctatcaggggaccatggagatcaccctacaatctggaactgtgtttcaataccctatatcctctatgtattccggtgtggattatactagtgttgacataaccaacactggaactagagcattgaagcaagttgaggttcaagctactgatcaacaatcccaggaaggagatcacaatgtacaacctgataaagaagtcgaagaaagaaaagtcctctttactgagtag

SEQ ID NO: 15 - DNA, 1062 bp, Colysis wrightii
atggcgttgtatcagacacctgtgtatgtgatcggagggcaaggtggcaactcgtttacttacgatcagagcaggaacgggaaggtgttgacgaagattggggtgtgggctggcgagtggcagctgcgcggcatccgggtttggatgtctggctccgatagcccgaccacctttggcacagcctcgggctcttactctgaatacacatttgcagctggcgagcgcatcacccggttgtctttgtggggcaacggtgctggtacgcggtctggagccattagattctacacgacaactggaggctcatttttcccaaaaatgacatcttgggacttaaagactgagtatccaattgatgtggcatccggtctttgtgtggggatcataggacgagctagtgctgacattgattcattggggtttatgtttctcagaaccatagcatcttctcgcatgatcaatgtaagctacccaaccttgggcttagagcaagctggaattatccccgtcacgcttgattcgtacaacgactctaataatgcaggttctatttccaagaattggactttctctggtagccgaacagttacaatatcatcatcatggacactcacttcagggatagaggcacatgctagtgtgaccgttcaagcaggtctcccctcggttgcagaagtgagcggagagtttggatggtcagtgagtgtaagtggaagctacacaagcacccaagaggagagtcgaaccctcacttggaaccaatccggaaccctagagccaggacaatggatttccatccaagctaccactcggagaggaaccatcaccttgccctatcaggggaccatggagatcaccctacaatctggaactgtgtttcaataccctatatcctctatgtattccggtgtggattatactagtgttgacataaccaacactggaactagagcattgaagcaagttgaggttcaagctactgatcaacaatcccaggaaggagatcacaatgtacaacctgataaagaagtcgaagaaagaaaagtcctctttactgagtag

SEQ ID NO: 16 - DNA, 966 bp, Colysis wrightii
atgtcttccggcagcgtgattggaggggtcaccatggttggcggcccctatggttcctaccaggaggtccaagcctggcaagtggggagctacatcagcaggctcacagtctattgggaaagcatgcgagtgagaggcgcaagggtgtgggtgaaggggcagagcgcctctaccacctttggtgacgcaactgggtctagcgcagattttgagttcgaaactggggagacgatcactgccatgtccctgtggcagggggagtgggagaacccggaccacatccgggctggccacctctatttcacgaccagcaatggtcgggaatttagtgccggtccatcgacaatgtggtccgagaccgtaatcgatgtccagtcggggtggttggtggggctgcaagcctacactggggacgacatcaacaagtggggcttcgtcttcctcaagcccctcctcgtctttgctctcgccgacgtccagtacactggccttcaggatgtgggcgcgattgtgcccaccacactcgatagtctcgatgagaccaacaacagcagcaccggctcagacgtcaactggtctcttgaaggcagcaaggcggagacggtgtcatggtccttttctactacggactcgctcactgcaacaataggttttgaggtgtccgctgggattcctgaggtggctcaagtcaaggagagctttcagtttcaagtcggcacttctacaaccagatcatcgagttacagtgaagagcacacgttgacatggtcgaccgggggcgttcttaagccgggtcagcacgttgttgcatctgccgtcacccaggtgggcaccctttccggtctgccctacactgccactgttgtaatcaagacgaaggacgcctcttcctacagctacgcaaccagcggttcttattcgggcatatcctgtactgaagttcagcttgacgttaaagttacttga

SEQ ID NO: 17 - DNA, 1122 bp, Selaginella kraussiana 'Variegata'
atggctcagctccagcagcacgttgtcaactccaagcatgcatatggcaagcatgctcccgcaagtaaagtgtgcgaaattgcgcgtgctcctgtgcatgcctataagggcagtaatcaaggtgacgttactgccccgcttacgttcattggcggtgacggtggcaaacaagtcagcaaacgcgcctgggagtcgggcaagctcatcaccaggctccgcgtctatagcggctactcgtgcatcaaggccatgaaggtctggtttactggcgacgagtactctgagggcacttgtctcggagaaccggatggtacagactacaaggagtatactttcagtgaaggagagcggatcactcgtatgtccctttgggggaatggaaacggcactcgtgctggttggatttcccttagcacgaacaaaggcggcgtcttttcctatgggatgcatgggtggccattgtgcactgaatacccggttaatgttggttctggcattcttgccggggccatttataacgctggctgcgatattgatgctcatggttattacttcctgagttcctccgttactagctctaaattggagaatgtgaagtaccccacccttaagtttgatacctccgggatcacccctgtctctttggacacatacaagcaaacaaacacatcgtcctccccgcgaaactggagctttggaggcaaacgtaccgtcaaaagtaccacgaaatggggcctcaagatcgccaacaccttcaacgttgagcttagtgtggaagccggagttcctcaggtcagcaaatccggggcgaagttcgggtggaccatttcggtggcgagtgatcacgaggagtcggaggagcgcacccaggaactggtgtggagcactggaggaacactgcagccaggtgaaactgtggatctcgtggctctgactcgtcaagggaacctcaatgatctgcgtttcgagggcaccatggtcgtgactctgaagaacggtgcaagcttccgcttccccttatcaggtccttacaaaggcatctgctacaccggtgttgaaatcaaagaccacgaggagactaaaaccatggcgatgaagtcttacgctagcctgtgcctgtaa

SEQ ID NO: 18 - DNA, 1203 bp, Selaginella kraussiana 'Variegata'
atgtcgatccatcaaacacccgtgaccctcatcggaggaagaggcggagcggcgttcacgtacaatgcaggcgcgagcggccgcatcttgaggaggatcggagtatgggccggcgggtcgcagctgcgaggcatccgagtgtggtggactggcctggattcccccattacttacggcactcctaacgttggctcctaccaggagttcacctttcaggatggcgagcgtatcaccagtctctctctatggggcaatggagcaggtacacgcagtggtggcattaggttctacacgaccacgggaaggcggtttttccaccacatgacctcttggggcctgaagcaagagtatccagttgacgtagtggatggcgtgtgcgtaggcttgactggaaggcagggtgccgacatcgatgccttgggcttcatgttcctacgcaccatgacctccgctcgcatgatcaatgtgaagtaccctaccctcggcctggagacggcaggcattgtgccagtcacgctggacttcatgagcgacagcaacaatgctagctccatttccaagacttggtccttccaaggaagccgagaggtgaccgtatcctcctcctggagtaccaccacgggcattgagcttcatgcgagcatcaccgtatcggcagggatccctctcgtggccaatgtcgaagggcaatacggatgggccatcagcacaagctccacctacactaccaaccactcggagactcgcacccttcagtggcagaattcgggcgtcttggagcccggtcagtggatctctctgcaagccctcacgcggagaggaaccatcaccctaccctaccaagccaccatgcaaatcaccctccagaacggcaccgttttcacctacccaatcactgctcagtacgcaggagtggattataccagcgtcgagattgtgagccagggaacaagagatttaggctctgatcacttggccatcaacaaggatgtccgctacatcgctgctgccaatggtgcagctgttggtacaactacaactaacgcaccgccccactacgtccaccctatccgaggagcgcctattgttgaacccgtcaagtttagtgtaggtgcaacttacatcaatgacaccgacaatatcactcaggaagttgacactactgcagctactagtgtggaagagcttacccttgtgtactag

SEQ ID NO: 19 - DNA, 1188 bp, Selaginella victoriae
atgcaatatggcctggccaatactgaagcaagccccctgatcgagaagttccaagctctaatggaaggcggcatagatgagagcatccttgcgactaagcttgttggtgctgaaggagatgcttctcatttgccaccacctggagagacgcctagtgaggatggtgccggcaaggatccacccaatgaatcgctggagactgaagatgtagaggagcatgctgatgatagcaaagcccgttctgctagtgtcacggcccctctgcgcttcataggcggccccggtgggtcgcaacgttccgtccgaggatggaccaacggcagggtcatcaccaggatgcgtgtctacagggcccgggggactatcaaagcgtaccagatctggctcacagactctgctccccagactcatggtgttcctgggaacagcgacttcgccgagtacacgttccgcaccggagagcgtcttacaagattaacactgtggggaaacggaatgggcactcgtgctggatggatcgagtttgagacgagcttgggtggaaggttttcatatggcatgagccattggtcgctgagaactccttaccctgtcgacgtcggttctggcatccttgtgggctacatttttaatgctggagaggacgtcgatgcacacggcttctggtttctcaaccacattgagcaggccgagctcaccaatgtgaggtatccgactcttggatttgacacggcaggtattgtacccacggccctggataccttccggttcagaaacaactcatccacgccaagagactgggacttcagccggaacatgagcaggagcactgagcggacatggtcgatcaccgtggatcttactgtccatgcgagcatcacggtgagtgcagggtttccaggcattgcaaacgtgagtggtcagtatggatgggagattggggtgacgggccatttcgaaacaacagagacgtccgagcacgacttgagctggagcgtgggtgggagagtccagcctggggatgttgtcgatctcactgcgctcactcggactggaactcttaacattccttacgaaggtacgatggtggtgaggatgagaaatggtgcctccttcagctatgccgtgcgtggaacctacagaggccttagctataccggcacaaaaataaacgacaactcaacttaa

SEQ ID NO: 20 - DNA, 954 bp, Lycopodium phlegmaria
atggcttttcagacaccagttacgctcattggagcttccagtggtgggcagcagttttctgcttatrgcggcactgatggtaagttgctggaaaagattggagtgtgggctggggattctaggatcaaggcaatcaaagtatggctcaccgatgaagcagctcaattgtttggggatccacatgatcctcctggcgagggacctctgcattacaaggagttcgctttccagccagctgagctcatcaccagactatccctctggggaaacggggcagggacgagagctggatggatttattttgaaacgaatcaaagccgaagtttcgatttcggaatgtattcgtggggcaagaagaaggaatatcctgtggacgtggcgtctggaatttgtgcgggggtgatgggtaccgcagcttctgacatcaacaacattggattcgtgtttctgaaacccatccagagctcaaagctcataaatgttcaatatcctagcctttcgtttgacacccaagggatcagtcctcaaaccttgaaagagttcaaccacaccaatacctccaacaatcccacaaactgggagttcaagggcagcagcgcagtgaccgtctcttcttcttggtccctcaccactggactggcggttcatgcgagcgttacggtggaggccgggatccctgcggtcgcagatgtgagcggtgagtttgggtgggaagtgagcgcatcgacaaccagccagtcatccacgacagaaactgataccttgtcgtggggagtgtccggaactctgtcagcgggggaatcgattcatctcaaggcattgacaagaaaaggtttaatctcggttccttacattggaagcatccaagtcacgttgaaatctggtgacgtgtttcagtatcctctgaaagggcagtactccggcataagctactcaggagtgacggtcacttaa

SEQ ID NO: 21 - DNA, 954 bp, Huperzia salvinioides
atggcttttcagacaccagttacgctcattggaggttccagtggtgggcagcagttttctgcttatggcggcactgatggtaagttgctggaaaagattggagtgtgggctggggattctaggatcaaggcaatcaaagtatggctcaccgatgaagcagctcaattgtttggggatccacatgatcctcctggcgagggacctctgctttacaaggagttcactttccagccagctgagctcatcaccagactatccctctggggaaacggggcagggacgagagctggatggatttattttgaaacgaatcgaagccgaagtttcgatttcggaatgtattcgtggggcaagaagaaggaatatcctgtggacgtggcgtctggaatttgtgcgggggtgatgggtaccgcagcatctgacatcaacaacattggattcgtgtttctgaaaccaatccagagctcaaagctcataaatgttcaatatcctagcctttcgtttgacacccaagggatcagtcctcaaaccttgaaagagttcaaccacaccaatacctccaacaatcccacaagctgggagttcaagggcagcagcgcagtaaccgtctcttcttcttggtccctcaccactggactggcggttcatgcgagcgttacggtggaggccgggatccctgcggtcgcagatgtgagcggtgagtttgggtgggaagttagcgcatcgacaaccagcgagtcatccacgacagaaactgatactttgtcgtggggagtgtccggaactctgtcagccggggagtcgattcatctcaaggcattgacaagaaaaggtttaatctcggttccttatactggaagcatccaagtcacgctgaaatctggtgacatatttcagtatcctctgaaagggcagttctctggcgtaagctactcaggagtgacggtcacttaa

SEQ ID NO: 22 - protein, 339 aa, Asplenium australasicum
MALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQ

SEQ ID NO: 23 - protein, 356 aa, Asplenium x kenzoi Sa. Kurata
MSSLINPHLETIRYGGSFAGGSPFRILGETEGRVLQRIRISRMANAIDAIEFWLTGDSTPRVYGTVRSENSSFDFSEGERITGLRFRNALFGIGQNQWNHVARVWFSTSRGRTFEYGSTREPTGQWFEVNVGSGVCVGVAGNVMLNSLNMLGFVFLRSIQSVGFSSVEYPMFSTSITRTSILEQLPDTFKSNDDDEPLQMVLAGSRQFKTSSTWRVSSPTVGLLSHLTGNNILVDVTLGINTPTVVPTGLAGASTTFQWETVRAFPSTNAIQGSISNLTVSTDEYSVWCHISDTVAPAQSLPKHAAWVGEGRITALPCSANIQVFTSGGNNFPFGTFSFPVRLLYDGGAHSNVQVL

SEQ ID NO: 24 - protein, 340 aa, Polypodium musifolium
MALVISCPVGGQGGSFFNYYGGTDGRVMQRIKVWAAASRIKAISVWLSDGVQKTFGDPSRPAGEGDLRTSEFSFNTGETVTQLSLWGNGAGTRSGWIYFRTNQNRTFDFGMYSWGKKTEYPQDVSSGIWVGITGRAKSDVDALGVVFLQPILSCRLISVDYPTLQFSGTSGGTTSINLTTAGKTFNLQNAAHQEDPSSTEKLAWELADEPSFDNVSHTWSLSNISTRLLQFISTSTISVQARTPALAVVNNIVVGWQLSASDTESSSLSSSSSLLLPWSRNGSLLPSESLTLSALPFGGTVSGLPFDGSARVTTTGGTFSFSGLHGFYTGQSHVIAITTQ

SEQ ID NO: 25 - protein, 354 aa, Polypodium musifolium
MALYQTPVYVIGGQGGSSFTYDQSRNGKVLRKIGVWAGEWQLRGIRVWMSGSDSPATFGSASGSYSEYTFADGERITRLSLWGNGAGTRSGAIRFYTTTGGSFFPKMTSWGLKTEYPMDVASGLCVGILGRANVDVDSLGFLFLRTIASARMINVSYPTLGLEQAGIIPITLDSYNDSNNAGAISKNWTFSGSRTVTISSSWTLTTGIEAHASVTVQAGIPSVAEVSGEFGWSVSVTGSYTSTQEESRTLTWNQSGTLEPGQWISIQATTRRGTITLPYQGTMEITLQSGTVFRYPISSMYSGVDYTSVDITNTGTRALKNEVEVEAVDQQSQEGDHNVQPNKEVQESKVLFIE

SEQ ID NO: 26 - protein, 339 aa, Polypodium punctatum 'Serratum'
MALVIGWPVGGQGGSFFNYYGGTDGRVMQRIKVWAATSRIKAISVWLSDGVQKTFGDPSRPSGEGDLETSEFSFKTGETVTQLSLWGNGAGTRSGWLYFRTSHNRTFDFGMYSWGKKTEYPQNVASGIWVGITGRASSDLDGLGVVFLRSIQSCRLINVQYPTLQFSGTAGGTTSITRTTAAKTFNLQNTANQDDPSSTEQLAWQLADEPSFDNVSHTWSLSNTSTGLLQFISTSTISVQARTPALTIVNDVVGWLPSDSDTQSSSLSSSSSLLLPWSRNGSLLPSESLTLSALPYDGIVNGLPFTGSARVTTSHGTFSFSGLKGAFTGESHVIAVTAQ

SEQ ID NO: 27 - protein, 354 aa, Polypodium punctatum 'Serratum'
MALYQTPVYVIGGQGGSSFTYDQSRNGRVLTKIGVWAGEWQLRGIRVWMSGSDTPATFGSASGSYSEYTFADGERITRLSLWGNGAGTRSGAIRFYTTTGGSFFPKMTSWGLQTEYPIDVASGLCVGILGRANVDVDSLGFLFLRTIASARMINVSYPTLGLEQAGIIPITLDSYNDSNNAGAISKNWTFSGSRTVTISSSWTLTTGIEAHASVTVQAGIPSVAEVSGEFGWSVSVTGSYTSTQEESRTLTWNQSGTLEPGQWISIQATTRRGTITLPYQGTMEITLQSGTVFRYPISSMYSGVDYTSVDITNTGTRALKNEVEVEAVDQQSQEGDHNVQPNKEVQESKLLFIE

SEQ ID NO: 28 - protein, 358 aa, Polypodium punctatum 'Serratum'
MSSLINPHLESITYAGSFAGGSPFRILGETQGRVLQRIRVSRIATRIEAIEFWLTGDSTPRVYGTVRSENSSYDFAEGERITRLRFRTSRFGFGVQTQWDHVARVWFSTSRGRTFEYGSTREPSGQWFEANVGSGVCVGVAGNVMLDSLNMLGFVFLRSIQRVGFTSVEYPTISSSIARTFILSHLPDTFKSNDDDEPLQMVLAGSRQFKTTSTWRAQSPAVGLLSHLTANNITLDLTLGINTPTVVPTGTAGASTAFQWQTVRTFPSINAEIQGTIANLTVSTAEYSVWCHISDTVAPAQSIPKHSAWVGEGRITALPCSANIQVITSGGNNLPFASFSFPVRLFYDGGAHSTVQVL

SEQ ID NO: 29 - protein, 341 aa, Adiantum pedatum
MALVIGGLIGGGGGSYFSYYGGTDGRVMQRIRVWAATSRIKAISVWLSDGVQRTFGDPSRPAGEGNLRSAEFSFNTGERVTRLSLWGNGIGTRSGWIYFETNQGRRFDFGMYSWGKQTEFPQTVASGIWVGFTGRASLDVDALGVVFLRPIQSCQLMNVQYPTLQFSGSSGATSITPTASSTKSFTLLNTADHEDQSSTQQLAWELADEPRFDNVFLSWILSNPSAGLLQFITTSSISVQARIPALAVVNNVVGWQLSASDTQSSSLSSSSSLSLPWSRSGSLLPSQSLTTLSALTYRGDARNLFFNGSAQVTTTTGSRFSFPGLQGLFTGQSYVPAITSQ

SEQ ID NO: 30 - protein, 354 aa, Platycerium bifurcatum
MSLVQTPVYVIGGQGGNAFSYDQSRNGRILRRIGVWAGEWQLRGIRVWMTGTDTPATFGTATGSYSEYTFTDGERITRLSLWGNGAGTRSGGIRFYTTTGGSFFHKMTSWGLQTEYPIDVASGLCVGITGRANVDVDSLGVLFLRTIAPARMINVSYPTLGLEQAGIIPVTLDSYNDSNNAGTISKNWTFSGSRTVTISSSWSLTSGIETHASVSVQAGIPMVAEVSGEFGWSVSVSGTYATTQEESRTLTWNQSGTLEPGQWISLQATTRRGTITLPFQATMEITLLSGTIFQYAISSMYSGVDYTSVDITNTGTRASDHVEVEATEQQVQGVKDQSVQPNKEAKECTLLFAE

SEQ ID NO: 31 - protein, 355 aa, Platycerium bifurcatum
MSLLTPHLLTASAGGFIGGDIFRHSGETDGRVLHRIRLSREVARISAVEFWLTGNSTPYVYGTPRADNSSYEFVDGERITRLDFRTHLFGVVTIQWDNIARVRFSTSRGRIFEFGSSREPSGQWFTANVGSGVCVGMSGVEANGALTRLGFMFLRSIQSVGFSSVEYPTLSTSTILTTPILEQLPDTFKSNDDDEPLHVVLAGSRQLETTSTWTSPAVGLLSHLTGNDITVNVSLGINTPTVVPSGPEGASTTFHWQTVRTFPSSNAMEGSIANLTVTTNEYSVWCHISDTIAPAQLLPKHVALVGEGRITALPCSARIQVLTSSAYDLPFATFSFPVQSLYNGRAHSQVQIIDP

SEQ ID NO: 32 - protein, 360 aa, Nephrolepis falcate
MANLLTPLYMQPVQLAGSVNTSLGLWRVSSETEGKVLKRIRVYRLTRSIPAIEVWLTGDSNPHVCGTPGRAESSTFEFSEGERITTLVLQDAQNIPTHVGRIRFQTSLLRTFEYGMSVQPTGKVTTVNVGSGVCVGVRASHSSTYGISVFGFMFLRPIQSVRLHGLVYPTISSTSTITTTILQELPATIKNDNDHEPLHWVLAGSRQCITSSTWRTQPADREGLVSHLVGRAISINIDLGIDTPKIVATGGTAGASTNFGWETARTFPSTNAVEGSIADLTVRTNEYSVWGHVSDTLAPAQSLISRRAVLIGEGSIDNLQCSARIQVFTDADGGLPFATFTFPVGVLYSARAHSDVQVLS

SEQ ID NO: 33 - protein, 356 aa, Nephrolepis falcate
MTSLLTPPYMQPIQSAGGLFSSFIVSGETEGKVLQRIRVYRFSRNIAAIEVWLTGDSNPHLCGTPGRAESSTFEFSEGERITTLELQEDPQLPYTVVGRIRFQTSRLRTFEYGMSVQPSGRVITVNVGSGVCVGVRAGTALSVISILGFMFLRPIRSVRLHGLVYPTISSISTITTTILQELPATLKNDDDHEPLHWVLAGSRQCFTSSTWRTQLAYRAGLVSHLVGSAISINMDLGIDAPKIVATGGTAGASTNFGWETARTFPSTNAIQGSIADLIVSTNAYSVWGHVSDTLAPAQSLISRRAALIGEGRIDNLQCSARIQVFTNDSALSLATFTFPVGVLYSARAHSDVQVLS

SEQ ID NO: 34 - protein, 354 aa, Ophioglossum pendulum
MSLVQTPVYVIGGQGGNAFTYDQSRNGRILRRIGVWAGEWQLRGIRVWMTGTDTPATFGTATGSYSEYTFADGERITRLSLWGNGAGTRSGGIRFYTTTGGSFFHKMTSWGLQTEYPIDVASGLCVGIMGRANVDVDSLGVLFLRTIASARMINVSYPTLGLEQAGIIPVTLDSFNDSNNAGTISKNWTFSGSRTVTISSSWSLTSGIETHASVSVQAGIPMVAEVSGEFGWSVSVSGTYATTQEESRTLTWNQSGTLEPGQWISLQATTRRGTITLPFQATMEITLLSGTIFQYAISSMYSGVDYTSVDITNTGTRASDHVEVEATEQQVQGVKDQSVQPNKEAKECTLLFAE

SEQ ID NO: 35 - protein, 353 aa, Colysis wrightii 'Monstifera'
MALYQTPVYVIGGQGGNSFTYDQSRNGKVLTKIGVWAGEWQLRGIRVWMSGSDSPTTFGTASGSYSEYTFAAGERITRLSLWGNGAGTRSGAIRFYTTTGGSFFPKMTSWDLKTEYPIDVASGLCVGIIGRASADIDSLGFMFLRTIASSRMINVSYPTLGLEQAGIIPVTLDSYNDSNNAGSISKNWTFSGSRTVTISSSWTLTSGIEAHASVTVQAGIPSVAEVSGEFGWSVSVSGSYTSTQEESRTLTWNQSGTLEPGQWISIQATTRRGTITLPYQGTMEITLQSGTVFQYPISSMYSGVDYTSVDITNTGTRALKQVEVQATDQQSQEGDHNVQPDKEVEERKVLFTE

SEQ ID NO: 36 - protein, 353 aa, Colysis wrightii
MALYQTPVYVIGGQGGNSFTYDQSRNGKVLTKIGVWAGEWQLRGIRVWMSGSDSPTTFGTASGSYSEYTFAAGERITRLSLWGNGAGTRSGAIRFYTTTGGSFFPKMTSWDLKTEYPIDVASGLCVGIIGRASADIDSLGFMFLRTIASSRMINVSYPTLGLEQAGIIPVTLDSYNDSNNAGSISKNWTFSGSRTVTISSSWTLTSGIEAHASVTVQAGLPSVAEVSGEFGWSVSVSGSYTSTQEESRTLTWNQSGTLEPGQWISIQATTRRGTITLPYQGTMEITLQSGTVFQYPISSMYSGVDYTSVDITNTGTRALKQVEVQATDQQSQEGDHNVQPDKEVEERKVLFTE

SEQ ID NO: 37 - protein, 321 aa, Colysis wrightii
MSSGSVIGGVTMVGGPYGSYQEVQAWQVGSYISRLTVYWESMRVRGARVWVKGQSASTTFGDATGSSADFEFETGETITAMSLWQGEWENPDHIRAGHLYFTTSNGREFSAGPSTMWSETVIDVQSGWLVGLQAYTGDDINKWGFVFLKPLLVFALADVQYTGLQDVGAIVPTTLDSLDETNNSSTGSDVNWSLEGSKAETVSWSFSTTDSLTATIGFEVSAGIPEVAQVKESFQFQVGTSTTRSSSYSEEHTLTWSTGGVLKPGQHVVASAVTQVGTLSGLPYTATVVIKTKDASSYSYATSGSYSGISCTEVQLDVKVT

SEQ ID NO: 38 - protein, 373 aa, Selaginella kraussiana 'Variegata'
MAQLQQHVVNSKHAYGKHAPASKVCEIARAPVHAYKGSNQGDVTAPLTFIGGDGGKQVSKRAWESGKLITRLRVYSGYSCIKAMKVWFTGDEYSEGTCLGEPDGTDYKEYTFSEGERITRMSLWGNGNGTRAGWISLSTNKGGVFSYGMHGWPLCTEYPVNVGSGILAGAIYNAGCDIDAHGYYFLSSSVTSSKLENVKYPTLKFDTSGITPVSLDTYKQTNTSSSPRNWSFGGKRTVKSTTKWGLKIANTFNVELSVEAGVPQVSKSGAKFGWTISVASDHEESEERTQELVWSTGGTLQPGETVDLVALTRQGNLNDLRFEGTMVVTLKNGASFRFPLSGPYKGICYTGVEIKDHEETKTMAMKSYASLCL

SEQ ID NO: 39 - protein, 400 aa, Selaginella kraussiana 'Variegata'
MSIHQTPVTLIGGRGGAAFTYNAGASGRILRRIGVWAGGSQLRGIRVWWTGLDSPITYGTPNVGSYQEFTFQDGERITSLSLWGNGAGTRSGGIRFYTTTGRRFFHHMTSWGLKQEYPVDVVDGVCVGLTGRQGADIDALGFMFLRTMTSARMINVKYPTLGLETAGIVPVTLDFMSDSNNASSISKTWSFQGSREVTVSSSWSTTTGIELHASITVSAGIPLVANVEGQYGWAISTSSTYTTNHSETRTLQWQNSGVLEPGQWISLQALTRRGTITLPYQATMQITLQNGTVFTYPITAQYAGVDYTSVEIVSQGTRDLGSDHLAINKDVRYIAAANGAAVGTTTTNAPPHYVHPIRGAPIVEPVKFSVGATYINDTDNITQEVDTTAATSVEELTLVY

SEQ ID NO: 40 - protein, 395 aa, Selaginella victoriae
MQYGLANTEASPLIEKFQALMEGGIDESILATKLVGAEGDASHLPPPGETPSEDGAGKDPPNESLETEDVEEHADDSKARSASVTAPLRFIGGPGGSQRSVRGWTNGRVITRMRVYRARGTIKAYQIWLTDSAPQTHGVPGNSDFAEYTFRTGERLTRLTLWGNGMGTRAGWIEFETSLGGRFSYGMSHWSLRTPYPVDVGSGILVGYIFNAGEDVDAHGFWFLNHIEQAELTNVRYPTLGFDTAGIVPTALDTFRFRNNSSTPRDWDFSRNMSRSTERTWSITVDLTVHASITVSAGFPGIANVSGQYGWEIGVTGHFETTETSEHDLSWSVGGRVQPGDVVDLTALTRTGTLNIPYEGTMVVRMRNGASFSYAVRGTYRGLSYTGTKINDNST

SEQ ID NO: 41 - protein, 317 aa, Lycopodium phlegmaria
MAFQTPVTLIGASSGGQQFSAYGGTDGKLLEKIGVWAGDSRIKAIKVWLTDEAAQLFGDPHDPPGEGPLHYKEFAFQPAELITRLSLWGNGAGTRAGWIYFETNQSRSFDFGMYSWGKKKEYPVDVASGICAGVMGTAASDINNIGFVFLKPIQSSKLINVQYPSLSFDTQGISPQTLKEFNHTNTSNNPTNWEFKGSSAVTVSSSWSLTTGLAVHASVTVEAGIPAVADVSGEFGWEVSASTTSQSSTTETDTLSWGVSGTLSAGESIHLKALTRKGLISVPYIGSIQVTLKSGDVFQYPLKGQYSGISYSGVTVT

SEQ ID NO: 42 - protein, 317 aa, Huperzia salvinioides
MAFQTPVTLIGGSSGGQQFSAYGGTDGKLLEKIGVWAGDSRIKAIKVWLTDEAAQLFGDPHDPPGEGPLLYKEFTFQPAELITRLSLWGNGAGTRAGWIYFETNRSRSFDFGMYSWGKKKEYPVDVASGICAGVMGTAASDINNIGFVFLKPIQSSKLINVQYPSLSFDTQGISPQTLKEFNHTNTSNNPTSWEFKGSSAVTVSSSWSLTTGLAVHASVTVEAGIPAVADVSGEFGWEVSASTTSESSTTETDTLSWGVSGTLSAGESIHLKALTRKGLISVPYTGSIQVTLKSGDIFQYPLKGQFSGVSYSGVTVT

SEQ ID NO: 43 - DNA, 2430 bp, Asplenium australasicum
atggccgccggcgattacagtgtgctatatcaggatgtgaaccagatcagcatcagactagagaagatggacttctcggaggtgatggcagtgcaccgtatgttcgtccggatggatgatctcgacgtgagctccggcaccggactcctgtctggcgcagaaaaggtgaagcgcctgtacgtctttgcggatgtggtagagttgccatccaaacaactgcggcttccaggcacagacttgattgtcatactctgtcgcatctttgtcacaaatggccgccacagcacggagctgttcctgccctccatgaacatgagcatggtcgcccctggtaccgggagcattcggggagtgattctcagccccacaacggtactgacaacttcatccgacgccttgcagttcaagctgcaaagcggctccatgacatcagtcatgcggctcaaagacgtgagtgtggctgctacactcacctgcaatgttcaggctgcatcggcatccatgcccctgactgtcaagacaaccggcacatcgcccgggaacatctgcgttctgggcatgagcacagccgtcgttgttccagagagcgctgtggctgtcatcactgatgccaatattctgttgggcatgcaagtaacggtgctcatcgccgagctagtcaagattgcccacaactcggatgttctcattgctgcagtcactcggcacgtggaatggttgaaccacctattagttcaggcacatgccgctgctcccagtgaggatgttgtcgcgctcttatatcggacacaaggtttcatcaaactgcgaaacgaaggcttaattgttccgcggttgcaatatcgcatgtacaaagatctcattgatcgaatggtgcaagtggctcagagctacgaccaagacttcaagcagttgaagctgttcgtggaacaaaataagatacttgggagctatttgctagagcaaaacaaggcgtttgctgagaaggaaaaagacatggatgcttttcactcccaagtcattgatctcaggacttctgagcttgaaagcaccattgagagaatggatgacttaagcaaacaaatggaagaacaaaatgcagcaatggagcaagccaaagcggacatggacgcagggttgatagcgtatcaaaacaaacaagtcgcaaatgccgtctttgcggtcttgggggcgatcgccagtattggtctggcatttgcaactggcggggcaactgctcctggagccgtggcttccgcaggagcagctgttaccgcagctgggaaggcagctgagggattgaagaaagtggtagagattcttgaaggcttacaagcggtgatggaggtcgtcgctgtcataaaagagctggtacagtccttacaggagatagggcagcttgtggatgcccctgagatgccagatctgccgtcggatgcagaatgggagatttttgtgaatgaagtggaggcagtagcagagcagatgccaacagaggtgacagaggtgcctgcttggaaggccaagtgcaagaatgtggcagcactaggccgagaaatgagcactatggcggcgcacattgcagagttgcagttcgagatacaagtgcaagaaatgttgcgcgagatcgcgaagaaacaggcagataggctgtcgtccatcaagcccgcagacttgacgaactacttggagatggtgtccgaaatggacatgcgcacaacgcgcatgctgttggagctgattcgagtgctgtacatccagaacgcagcattgcagtacgaatatctgcagacaccggcgccattgaatgcatggccagtgacgatgcaaacggtgtgggggttgcttgtgcaacaagagacggccgcaattaacgggctgctgcagatgggggcgccctcggactacacacaagagtatgcggtgagagatgttcctgtgaggttgttactagggggtggagactgggagtttgagctgccagtgaggaatgctgatttcccactgacatggtgccgagtgcgcatacgatatgtggatatgcgatttgatgctgcagccgagcacctgcccgtcacaagcacgggggaagtgtacatgctgctgcagagttctcgcttcttcgaggatcgcgccaagcgtgagaacgagttcattagctacgagggcggcatgggccttcagtatcagtatgcctaccgcttggccacgggcgacgccaccgtcaccaacgtccccagcgaggagtatgccaatacttttatgcgcctcgcacccttcactcgttggcgcctccgcctttcggcctccgcgcccgagaacaagggcctcgcatttccaaccgccaccttggccgatgccaccacacgaatcaaaatcacctttcacgtctctgccattcgccgtataagcaccagagtcgccgtataa

SEQ ID NO: 44 - DNA, 2586 bp, Asplenium australasicum
atgggaggcgcggtgcccgactatagccatctgtacagggagctgaatcaggtgagcgaggggatgaagctggaccagatggagttctcagaggtgatggtcatccatcgcatgttcatcaggctgcatgatttgaacatagcccatcgagaaggggctgaacaagtcaagcgcctatatgtcttcgctgatgtggtggagctgtcgggaacgagtcttacgacgctgctacctggaaccatgatggtcgtcatcttgtgtcgtgtgctctccgtacggagttttcaatcacaacatggcttggattttcctcacatgaggctccatgccgttcccggtgacaatcagatgcttcgcatacatcgacgcaatcctgattctgcgcaatatgatgattatccagttgtttgcgtacacgcggatgtcctagagtttcctgttacaggcggtcgtgatatattccacctcgggccgcttgcaaatccatgcatggtcattacctttccaccgcagtccttagaggaggctccagtatcgtcttttactggtagtgttaggttatggaccgcagcagcgtcttcgcctcatagaatagaccccaacaacctgaccttcactcctggcttcatggttcagcagggcggtagctttaaccttccattcaacacgcaatctgaagacttctggttactccgaagaaatctcccagatgccctactgaaggactctagcatcctgctttgcatgcagaccagcatgctcatcgcggaactagtagagttcagtcatccttcatcggacgttcgtgcggctgtaacattgcacgcagaatggctcaacaatcttctgctccaggcgtcagcaaaatcacaaggaaccccacatcatgacgattaccgcgcgcttctattccgcgcgcaatacgtagtcaagggaatcggaaggtcccgaggtgctgtggtgccacaattgcagtatgatatgtacagcaaccttatcaatcaaatggctcgtgcagctgatagctatgaccaatcgcttaaacagcttaaactctttatcgctcaaaatgagattctcggagaatacttgctagagcagaatagggtctttgctgcgaaggagagagacatggaggtctttcattctgagctcatcgctcagaaaacgaccgaactccaaaccgtcatggtcaagattgacaacttgagcttgcaaatggaggcccaagtagaagatatggagcaagccagagaagacatggaagcagggttgaggagatttcgaaatcgacaggtagcaaacgccatgttctctgtgtttcgtgctataggcgcagttgcgcttacagtgttaactggtggtgcggcagctccgttggccatatctgcggcaaagggggctgtgtccattgctggccaagcagccaggggattggagagggttttgcgaatcctcgacgatttgcaggcagcaatggagttactgaagatcataaaagacttggtggagtctctccaggaaataggtcagctggtggatgcacctgacatgccggagatgccaacagaggccgattgggccatctttgtcaacgagatcgagggagtagccgagcaaatgccagaggaagtgtcggaggtatccgcgtggaaaacatcgtgcaagaacgtagccgcggtgggtcgtgaattgatgacgactacggcgtacatgtcgcaacttcaatacgacatccaggtgcaagccatgctgcaaggtatcgcgagcaaacaggccgatcgcctgtcttcaattcaagctgcggacctcagcagcttcacagaaatggtgacggaaatggacatgcgcacgacacgcttgctagtggagctaataaaggtgctacacatgcagagcgtagctcttatgtaccagtctctaacactgccagaactgatgaacgcgtggccggtgacgatggagacggtgtggcgcatgttgatacagcacgagcatgcagccgttcttgggctgatcaggctaggaccatcctttgatttcagaaaaactcttacagtgaaggacattcccgtggatctgctgctgcatggtgaggattgggagttcgagatttctgtggacgatttcaccgtcttcccgcgcacatggtcacgggtgcgcattcatcacttggagatgaaatttgtcggcagcggcgatgaggctgcgccagggggggggatgcaaggggctcaccagcccgccacaaaaactggggaggtctacattctcctgcagagctcgcgcgtcttccacgaccgcaacaagacaaaacctctgcactacgaggccggcatcccgctcgactaccactacgcctacaatctggaaacaggagagaccacactctccaacctcccctcccatgactttatccgagcttttatgcgcatgacgcccttcgcaacatggaggctccgcgtctctgcctctgcccaagaaaatgaaggcctggcctttcccactgccacggttggtgccggtgacaccacacaaattgctatcactttccatgtctctgctattcgggagatcgccctctga

SEQ ID NO: 45 - DNA, 2718 bp, Asplenium nidus
agagagagaggggtgttaaatggcatgctaacgagcgatcatccattttggggtgactggggtgtgtgttctgaagctcatcgttcaatctgtcttgtgtgtcccgatcaaagtctacacgagatcgccatgggaggagcggtgcccgactatagccatatgtacagagagctgaaccaggtgagcgagaggatgcggctggaccacatggagttctcagaggtgatggttatccatcgcatgttcatcaggctccctgatttggacatagccttacaagaaggtgctcaacaagtcaagcgcctgtacgtctttgctgatgtggtggagctgccggaaatgagtacgtcggtgacggtgtcggaaacggtgacgctgcggttacctggaaccgtgattgtcgtcatcttgtgtcgtgtgctcttctatcagggttttgcaagatatgacttggacttccctcacatgaggctacatgccgttcaacccagtggcgcgggggtccttcgcatgcatcgactcaatcctgattctgtgcaatacgatgattatccagttgtttgtgtcctcgcggatgtcgtggagttcacgagacagcgccctagtcgtttatttcgtattgggccgcttgcatatccgagtatgatcttcaccgatgaacgccctccagcttcctcaattgtggagcctcggccagtatcgtctttctattgtactattgaattccgttggtcttcctctaataatattgggcccaacagtgtgggaattggatgtgtttttcgcttatctgggggttctacatttagtactggcagtccaagagaggacttctggttattcaggagagatctcccagatgccctgtttaaggattctagcattctgccttgcatgcagaccagcatgctcgtcgcggaactagtagagttttgtcatccttcaccggacgttcgtgcggctattaggtcgcacgcaaaatggcttaacacccttttactccaggcatcagtggcatcagaaggaaccccacatcatagcgattacaacgcgcttctgtttcgcgcgcagtacgtcatcaagggagttggaaagtcacgaggtgctgtggtgccgcaattgcagtacgatatgtacagcaaccttgtcaatcaagtggctcgtgcagctgatagctatgaccaatcgcttaaacaacttcaactcttcatcgcccaaaatgagattcttggagaatacttgctagagcagaatagggtctttgcggctaaggagagagacatggaggtctttcattctgagctcatctctcagaaagagaccgaactccgaactgtcgtggccaaaatagacctattgagtttgcaaatggagacccaagtagcagatatggagcaagccagagaagacatggaagcagggttgaggagatttcgaaaccgacaagtagcaaacgccatcttctctgtgttccgtgctatagccgcagttgcgctgacagtggtaactgggggtgcggctgctccactggccatgtctacggcaaagggggctgtgagcgctgctggccaagctgccaggggattggagagagttttgcagatcctcgatgatttgcaggcagcaatggagttactgaagatcataaaagatttactggagtctctccaggcagtaggtcagctggtggatgcacctgacatgccggaaatgccaacagaggccgattgggccatctttgtcaacgagattgagggagtagccgagcaaatgccagaggaagtgtcagaggtatctgcgtggaaaacatcgagcaagaacgtagccgcggtgggtcgtgaactgatgacgactacggcttatatgtcgcaacttcaatacgacatccaggtgcaagccatgctgcaagatatcgcgagcaagcaggccgatcgcctgtcttcgactcaagctgccgatctcagcagcttcacagaaatggtgacgcaaatggacatgcgcacgatacgcttacaagtggagctaataaaggtgctagacgtgcagaatgtagcacttatgtatcagtctctggtaaagccagaactgatgaacgcttggccagtgacaatggatatggtgtggcgcctgttgatacagcacgagcacgcagctgttcttgggctgatgaggctaggaccatcctttgatttcagaaaaactcttacagtgaaggacattcccgtggatctcctgctgcatggtgaggattgggagtttgaaattcctgtggacgatttcagggtcttcccggccacatggtcacgggtgcgcattcatcacttggaaatgaagtttgctgctgcgccagcggggacgcaaggggctcaccagcctgccacaaagagtggggagatttacattctcctgcagagctcgcgtgtcttccatgaccgcaataaggcggaacctcttcactacgaggctggcgttccgctcgactaccactacgcctacaatctggaaacaggagagaccacactctccaaccttccctcttatgactttatccgagcttttatgcgcatgaccccgttcacaacatggaggctccgggtctctgcctctgctcaagaaaatgaaggcctggcctttcccactgccacggttggtaccggagacaccacacaaattgctatcactttccatgtctctgctattcgggagatcgctctctga

SEQ ID NO: 46 - DNA, 2601 bp, Asplenium x kenzoi
atgggaggagcggtgcccgactatagccatatgtacagggagctgaaccaggtgagcgagaggatgaggctggaccacattgagttctcagaggtgatggttatccatcgcatgttcatcaggctccctgatttggacatagctctccaagaaggtgctcaacaagtcaagcgcctgtacgtcttcgctgatgtggtggagctgccggaaacgagtacgtcagcgagcgcggaaccggtgacgctgcggttacctggaaccgtgatggtcgtcatcttgtgtcgtgtgctcctctttcagggttcttattcagcatatgatttggactttcctcatatgaggctacatgccgttcccggtgaagctcagatccttcgcatacatcgacgcaatcctgattctgcgcaatatgatgactatccagttgtttgcgtacacgcggatgtcctagagttccctgttacaggcggtagggacatattccacctcgggccgcttgcaaatccatgcatggtcgttacccatccacagctttccttagtggaggctccagtatcgtctttcactggtagtgttaggttatggtccgctgcaacgtcttcgcctcatagcatagaccccaacaacctgacctttactcctagcttcagcgttcagggcggtggtagcttcaacctttcattcgccacgcgatctgaagacttctggttactccaaagaaatctcccagatgccctactgaaggactctagcatcctgctttgcatgcagaccagcatgctcatcgcggaattagtagagtttagtcatccttcatcggacgttcgtgcggctgtaacattacacgcgaaatggctcaacacccttctgctccaggcatcagcaaaatcagaaggaactccacatcatgctgattaccgcgcgcttctattccgcgcgcagtacgtagtcaagggagttggaaagtcacgaggtgctgtagtgccacaattgcagtatgatatgtacagcaaccttgtcaatcaagtggctcgtgcagctgatagctatgaccaatcgcttaaacaacttcaactctttatcacccaaaatgagattcttggagactacttgctagagcagaacagggtctttgccgctaaggagagagacatggaggtctttcattctgagctcatcgctcagaaaaagaccgaactccttactgtcatggccaagatagacctattgagtttgcaaatggagacccaagcagcagatatggagcaagccagagaagacatggaagcagggttgaggagatttcgaaatcgacaggtggcaaacgccatgttcgctgtgtttcgtgctataggtgcagttgcgcttacggtgttaactggtggtgcggctgctccattggccatatctacggcaaagggggctgtgagcattgctggccaagctgccaggggattgcagagagttctgcaaatcctcgacgatctgcaggcagcaatggagttactgaagatcataaaagatttggtggagtctctgcaggaagtaggtcagctggtggacgcacctgacatgccggaaatgccaacagaggccgattgggccatctttgtcaacgagatcgagggagtagccgagcaaatgccggaggaagtgtcagaggtatctgcgtggaaaacatcgtgcaagaacgtagccgcggtgggtcgtgaattgatgacgactacggcgtacatgtcgcaacttcaatacgacatccaggtgcaagccatgctgcaagatatcgcgagcaaacaggccgatcgcctgtcttcaattcaagctgctgaccttagcagcttcacagaaatggtgacgcaaatggacatgcgcacgacacgcttactagtggagctaataaaggtgctaaacatgcagaatgtagctcttatgtaccagtctctaacaatgccagaaccgatgaacggatggccagtgacaatggagacggtatggcgcatgttgatacagcacgagcatgcggctgttcttgggttgatgaggctgggaccatcctttgatttcagaaaaactcttacagtgaaggacatccccgtggatctgctgctgcatggtgaggattgggagtttgaaatttctgtggacgatttcaccgccttcccagccacatggtcacgggtgcgcattcatcacttggagatgaagtttgttggcagtgaagaggctgcgccatgggggatgcaagggcctcaccagcctgccacaaaaagtggggagatctacattctccttcaaagctcacgtgtctttcatgaccgcaataagacgaaacctcttcactatgaggccggcattccgctcgactaccactatgcctacaatctgggaacaggagagaccacactctccaacctcccctcttatgacttcgtccgagcttttatgcgcatgacgccgttcacagcatggaggctccgggtctctgcctctgctcaagaaaatgaaggcctcgcctttcccactgccaccgttggtgccggtcacaccacacaaattgctatcactttccacgtctctgctattcgggagatcgctttctga

SEQ ID NO: 47 - DNA, 2712 bp, Asplenium x kenzoi
atggcagcacgtagtgcaggagcggctgacggctggagggaggtgtatcgaggtctgaaccaggtgagtgacaggataaggtttgatcagttggagttctctgaggtgatggtgatccaccgcatgcacatcaagatgtcggagttggatttggggcatctggccggcgcggagaaggtggagcgcttgcatgtgtttgctgatgtggtagaatgtgatgtcccacctcatgagaattcctcggatccggacttggtaatccgactgcccgggtccgtgtccgtaacatttatgtgccgtgtgtggcacgtcaactatggtattgtgcagcgtactagtaccgtgcgcgttgccaggaccgtggtggtacagctcccgcacatgaggttgcatttcaatgcgactactggtagtatgcaccgtctacacccacaaacttcgcaagacggttcggatacttgcttttgtgtgtatgcggaggttgtacagatcgcctattaccctgatgtaacataccctgagtccaacgactcgcccgtcggccttagatttttacggcttgagttcgggtcggatcagctccgagtcacccgccaatctgaaggtccagtatgggcgcttcggggctctttaaactattcaatgtcacctgacaatgatgggcttatgaatgaggtatcatcgcagccagcaggcaccagtttcatactcaatatactgccggacaacctcaaccttcaattaatggcaagtttaagacgtaattctaattcaaccctaacccgggatccagacaacattgtacctgcgttctctgtttacagagagaagctggcagtcgaacttctcacagaccccaacactttgcctcctatgcagaccagcatgcttatcggggaacttgtggaggttggtcagcctccagaagcaaccattgaagttgtgcgcaagcatatagaatggctcaacaatctcttgcttaaggtgattgaagccaagcaaggcgagcctgtggaggattacattgaactatcgtttcgtgcgcagtatgtaataaagaaagtgggaagggtacaacgcctggtagtgccgcagttgcagtacagcgcatacagcaatctcatcaatcgattggctcaggtagctgaaaactatgaccaggcactcaggcagttcaggctcttcattcagcaaaataagatcctgggtggatttcttttggagcaaaatcgggcctttgctgagagggagcaggacatggacgttttctattccgagctcatcactcaaaggaaaattgaactggacaacactcttcaaacgatgaaacacctgggcgcacagatggaaactcagacagcaggcatggagcaggcacaggcagacatggaggcagcaggcattcggcgattccaaaatgcacaagttgccaggggcctctttgctgtgctcggtgctatagcagcggttggtctaaccttgctcacgggaggcgctgctgctcccctggccgtgtcagcagccaggagggttgtaacggtagcaggagcggtggcgcaagggcttcaaagggtgatcgacatcttggagggcttgcaagtcgtaatggaggtggtggaactcatcaatgacttgatctcttccctgcaagatttaggtcagcccgtagacctgccagaaatggcagagttgccaacgcaggcagactggctcatatttgtgaatgaggtggagggcgtggcggagcagatgccaacagaagtgtcggaagtagttgcatggaaaaccaaatgcaagaatgtagcggtgctgggtcgggagatgacgacgctagcagcctacatttcgcagctccagtatgacatccaaatgcaacacatgctgcagcagattgccagaaagcaggttgatcggttatcagccatccagctgccagaccttaaaaactatgcagagctggtgacacagatggacatgcggaccacgcgcttgttggtggctctcatcaaggtggtgaacatccagaatgcggccctgatgtatcagtacctctctgagcccacgcctgtgtatgcatggcctgtgagcatggacagcgtgtggcgcatgctcgtgcagcacgaacagtttgcggttcagggcctgatgaggttgggtcccgcctttgatattgtgcgcgcatatgtagtaaagagcattcctgtgagcttgctcttggaaggagatgattatgaatttgaacttccggtagaggaccacatcacatttccattatcattgtcgcgtgtgcgcatccatcaccttgagatgaagtttgtgcagggtgcagcagggggtagtgaccaggggacacagattgtccacatgcccatcacagacaccggctctatctacatccttctgcagggatcacggaacttccatgaccgcaatgagagcgcgatccttcattatgaagcggcaacatcgctggactaccacttcgcctaccgccttgacacgggtgcgagcactgtcaccaatttgccctctgccgagttcctcacaaccttcatgcgcatgacacccttcactaattggagggtccgtgtgtctgcctctgcggaagagaacaaagggttggccttccccaccgccacatccgccgatgctgccactactcatattgccatcactttcttcatttctgcaatcaggcaggtcgctctctag

SEQ ID NO: 48 - DNA, 2679 bp, Asplenium x kenzoi
atgcacccgacaggtcatgacgggatcagcatccccttggagcagggcgatgatgactatgcagaggagagcaggcagatgatcaggccgaggttcaaggccaacggtctggagctggactacgagagaatttacgcagggtcaaactcgatagcgcgggaggtgggtctgaataaggtaatatgcggtgaggtaatggccattcaccgaatgttttttaggctggacactttatcccaagagctattgcggcaaccggagctggttaagcgtctcgtcgtggtcgctgatgtggtagagattgaaggcgctaatgccaccctctcgctgcccggctcatctcttgtgcttatcttttgccgcattctcatcctcaaaagcagagacgtggttctcgaccttagcaattgggatttgagggttgctaccactactccgcttcatcgctgctccattcgtgctcaacgagttgtcgttgcttcgggctccctctctgcctctctgctcattcaggtgaaacataaatttgaatggagcgatggcactcatcttgatcagtattttcggcgtccaatctctttcaccgcatctaggatcaactcttctgctgcaatcaccaccaggactacatcggctacacggtcaatcaacacgtggccaggaacagcacccgtgtcgaacttcattcaagtgaactctgaaaagttcaatgtgcttgtaaatgcagtcccatggaagggcgtcgtcgattgccaagctgcattgccttcattagatgatcttttgcatcctgatgttattagtggcattcaatctactctacttattgtggaaaccatccttaactttcaaactgacaatccggatattattgtcctcgcacgacagcatgctgaatggattgtggacagcttgcttcaggtggtgcctttgccaaactctacattgggtgttcctgaggtaaaaactcttctggcgcgtgcgcaaatgctcataaaattgcccacggatggaagccagcacttgagagttccattactagcttatggtgagtaccaagaagatattgagcggttgctcagaaatgcagaggcatacgaccaagagtacagagcgcttacccgattcgtacagctagtcgagatcataggcagcgagttcctgcagctaagcaagactctcgcccaaagggagcgggacatagaaacgttcgagtccttggttgtcattcgcaagcaaagtgagctggatcaggccattaggagaatgaactcattgatgacagaaattgagagaagaagttttgagatggccgacgccaaagccaggatggaagaaggtttgcaggactacaacagaaggcaattgactagagcaatctttggaattctaggagctttactacagctttgcgcatccctgaagtttggtggaggggcggacattgcggggggcattgcaacaacagttcctgcagcaatagacctgatacatgcggtgcaagatgacagtgcaagtaccaagcttttggccatatcgcagaccttaatggatttagagaagatagttgatgttgtaaatgcagtgaacgagctagtggagagcgccacagagctggaggacatcatacatgctccagagttgcctatcatactaccttatacatgggatatcctggaaaacgacattgaggagtttgcagctctcatgccgtccgaggtgtcggaggtggtaacatggaaggccaagtgcaggaacttagtcgcagtgtgcagggaaatttgcatcgctgccagctttgcctgcgaggtgcaatatgagctctttgtgcatgcaaggcagcaagagatggcaaggaggcaagcagaacgcttggagggaatgcaaacagcagccgacttgagcagcttcatagagctggcaacacaggcggacatgcgcactacacgccttctcctaagcctgctcaatgtactggctggccatcagggggcactccactatcactacttgatggagttggaggtgttcacgtccagctggccgtcagtcgatggcgtgaggatgcatctgctgcagctgaatcaaagggctcgtgcccgagagaacgcgttatttggcgatggagtccttactgtggatttgcagcacgactatgtgctggacgccatacccgtgagcttgctcttgtcaggcgaagattggagcttcacaatcaatccagagcgaaatgcttctgcttttccaacgccgtgggattatgtgcgtattcggtacgtggagatgaaattcacgggagagcacctgccagtgaccgatacaggagagatttacctgctgctcagatcatctgccaacttccaagacaggttggaagagcaggtgtttgagtatgaggccgctgtcccgctcgtttaccaatatgcctacaacctctcgaccggtgaaacaacactccccaatctaccgtccgagagcggcaaattctttcgcatgacacccttcacgcgttggagactgcgtctctctgcatccgcataccagaatgagggtgtgtccttccccacaatccctggtgatccaacctcagctgatacccccgtccggattacaatcaccttctacgttactgcccttccacaaatacagtcacgctctcttctcgatatgtcaacttga

SEQ ID NO: 49 - DNA, 2424 bp, Polypodium musifolium
atggccgacctcgattacagcaagctttaccaggatttgaaccagatcagcgtgaggctagagaagacggaattctcggaggtcatggtagtgcaccgtatgttcgtccggatggatgacctcgatgtgagctccggctccggactcctgtctggcgcagaaaaggtgaagcggctctacgtctttgcggatgtggtagagctgccatccaaacaagtgcggcttgcaggcacggacatgattgtcgtgttctgtcgcatcttcgtcccagagggccgccattacgcggagctgttcttgccctccatgaacatgagcatggtcggcgcagatggcgaggggagcattcggggagtgattctgagccccacagtgctaacaactttatccaacgccttgcagttcaggctggaatgcggctccatgacatcagtcatgcggctcaacgacgtgagtgcgggtgctacactcacgtgcaacgttcaggctgcatcggcatgcgtgcccctgaaggtcaagacaaccggcacatcgcctgggaacatctgcgttctggggttgagcacagccgccgttgttccagagagcgttgtggctgtcatcactgatgccaatattctgttgggcatgcaggtaacggtgctcatcgccgagctagtcaagattgcccacaactcggatggtgtcattgctgcagtcactcggcatgtggaatggttgaaccacctactagttcaggcacaggcggctgctcccagtgaggatgttgtcgcgctcttatatcgtacacaagctttcatcaaactacgaaaggaaggcttaattgttccgcggttgcaataccacatgtacaaagacctcattgatcggatggtgcaagtggctcagagctacgaccaagacttcaagcaaatgaaactgtacgtggagcaaaataagatacttgggagctatttgctagagcaaaacaaggcgtttgctgaaaaggaaaaggacatggatgcttctcactctcaagtcattgctctcaggacttctgagcttcaaagcaccatcgagaggatggatgacttgagcaaacaaatggaagtacaaagtacagcaatggagaaagctaaagcggacatggacgcagggttgatagtgtatcaaaacaaacaagtcgcagatgccgtctttgctgtcatggaggcgattgccagtattggtctggcatttgcaactggcggggcaactgctcctggagctgtggcttccgcaggagcagctgtttccgcagctgggaaggcaggcgagggattgaagaaagtggtagagattcttgaaggcttacaagcgattatggaggtcatcgctgccataaaagggctggtgcagtctctacagaagatagggcagcttgtgaatgcccccgagatgccagatctgccgtcggaggcagaatgggaaatgtttgtgaaagaagtggaggcagtggctgcgcagatgccaacagaggtgacacaggtgcctgcttggacggccaagtgcaagaacgtggcagcactaggccgagaaatgagcactacggcggcgcacattgcagagttgcagtacgagatacaagtgcaaggaatgttgcaacagatcgcgaagaagcaggcagataggctgtcctccatcaagcccgcagacttgacgaactactttgagatggtgtccgaaatggacatgcgcacaacgcgcatgctgttggagctgattcaagtgctgaacatccagaatggagcactgcggtatgaatatctacagccagcggcgccattgaatgcatggccggtgacgatgcaaacggtgtgggggctgcttgtgcaacaagaggcagccgcaatcaacgggctgctgcagctgggggcgccttcggactttacacgagagtatgtggtgggagatattcctgtgaagttgctactagggggtggagactgggagtttgagctgccagtgacagatgctgatttcccattgacatggtgccgagtgcgcatacaacatgtggacatgcaatttgatgctgcggccgagcacctgcccaccacaagcacgggagaagtgtacatgctgctgcagagttctcgcttctttgaggatcgcgcccagcatgaggacgagttcattagctacgaagcaggcacaggccttcagtatcagtatgcctaccgcctggccacgggcgaggccaccgtcaccaacgtccccagcgaggcgtatgttaatacttttatgctcctcgcacccttcactcgctggcgcctccgcctttcgagctccgcgcctgagaacaagggccttgcatttccaaccgccacttcggccgatgccaccacgcgaatcaaaatcacctttcacgtctctgcgattcgccgtataagcttggccagataa

SEQ ID NO: 50 - DNA, 2421 bp, Polypodium punctatum 'Serratum'
atggccgacgtcgattacagcaagctataccacgatttgaaccagatcagcatcaggctagggaacgtggagttctcggaggtcatggtagtgcaccgtatgtttgtccggctggatgacctcgatgtgagctccggctccggactcctgtctggcgcagaaaaggtgaagcgcctctacgtctttgcggatgtggtagagctgccatccaaacaagtgcggctagcaggcacggacatgattgtcgtgttctgtcgcatcttcgtcataaacggccaccatggcacggagttgttcctgccctccacgagcatgagcatggtcgcagctggcgaggggagcattcggggagtgattctcagccccacaacgctaacacctttatcccacgccttgcagttcaagctggaaagcggctccatgacatcagtaatgcggctcaacgacgtgagtgtggctgctacactcgcgtgcaacgttcaggctgcatcggcatccatgcccctgaaggtcaagacaacgggcacatcacctgggaacatctgcgttctgggcatgagcacagacgccgttgttccagagaacgttaaggctgtcatggttgatgtcaatattctgatgggcatgaagttaacggtactcatcgccgagctagtcaagattgccaacaactcggatgctgtcattgctgcagttacgcggcatgtagaatggttgaactacctactagttcaggcactggtggctgctcccagtgacgatgttgtcatgctcttatatcgtacacaagctttaatcaaactacaaaaggaaggcttaattgttccgcggttgcaataccacaagtacaaagacctcattgatcggatggtgcaagtggctcagagctacgaccacgacttcaagcaattgaagctgtacgtggagcaaaataagatacttgggagctatttgctagaccaaaacaaggcttttgctgaaaaggaaaaggatatggatgcttctcactcccaactcattgctctcaggacttctgagcttgaaagcaccatcgagaggatgagtgacttaagcaaacaaatggaagtacaaagtaaagcaatgaagcaagccaaagcggacatggacgcagggttggtagagtatcaagacaaacaagtcgcagatgccgtctttgctgtcttggaggcggtcgccagtattggtctggcagttgcaactggcggggcaagtgctcctgaagctgtggcttctgcaggagcagctgtttccgcagctgggaaggcagccgagggattgaagaaagtggtagaggttcttgaaggcttaaaagcagttatggaggtcatcgctgccataaacaagctggtgcagtctatacagaagatagggcagcttgtgagtgccccagaaatgccagatctgccgtcggatgcaaaatgggagatttttgtgaatgaagtggaggcagtggctgcgcagatgccaaaagaggtttcacaggtacctgcttggacggccaagtgcaagaacgtggcagcactaggccgagaaatgagcactacggcggtgcacatttcagagttgcaatacgagatacaagtgcaaggaatgttgcaagaaatcgcgaagaagcaggcagaaaggctgtcctccatcaagcccgcagacttgacgaactaccttgagatggtgtccgaaatggacatgcgcacaacgcgcatgctggtggaactgattcgagtgctgaacatccagaatggagcactgcggtatgaatatctacagccagcggcgccattgaatgcatggccagtgacgatgcaaacggtgtgggggctgcttgtgcaacaagagacagccgcaatcaacgggctgctgcagctgggggcgccttcggactacacacgagagtatgtggtgagagatatccctgtgaggttgctactagggggtggagactgggagtttgagctgccagtgacagatgacgatttcccattgacatggtgccgagtgcgcatacattatgtggacatgcaatttgatgctgcagccgagcacctgcccaccacaagcacgggagaagtgtacatgctgctgcagagttctcgcttcttcgacgatcgcgccaagcatgaggacgagttcgttagctacgaagcaggcacaggccttcagtaccagtatgcctaccgcctggacacgggcgaggccaccgtcaccaacgtccccagcgacgcgtatgttaatacctttatgctcctcgcacccttcactcgctggcgcctccgcctttcgacctccgcgcctgagaacaaggaccttgcatttccaaccgccacttcggacgatgccaccacgcacatcaaaatcacctttcacgtctctgcgattcgccgtataagcctgtccagataa

SEQ ID NO: 51 - DNA, 2565 bp, Polypodium punctatum 'Serratum'
atggaaagagcagtacctgactacagccatatgtacagggagctcaatcaggtgagcgagaggataaggatggaccagatggagttctcagaggtgatggttatccatcgcatgttcattaggcttccggatttgagcatagcccatctggacggcgccgacaaggtcaagcgattgtatgtctttgcggatgtggtggaacttggaagcgtgcagcagacctcgagcctacctgggtccattatggtagtcatcatgtgtcgtgtcctcaccttgcatgtcgatcccatagcgacagcatatcaatgcgactttcctcatatgagactccatgctttttttggatcgaacggcgtgcgcatcgaccgacgcaattctgattctgtgcatgatgattatccagtgattaccgtgagcgcaaatgtcatagagttctctggtacaagagctgaaactttgtttgctattgcgccacttcgggatcccagtatgattatctcctccgacctaatctccaatacggtggagaggccagccagtggcttcttttgtaatgtggttccaaactggggacaaccctcccctattacggttgacccactccgcatacggtttcaaaccggagccaccatggtcgggggtggtagtcttacctttcccctaggtccagaaggattttcgatactccaaagaaatctcccagatctgctactcatagatcctaacattctgctttgcatgcaaactagcatgcttgttgccgagctagtagagttcagtcatccttcatcagacattcatgccgctgtaacagatcatgtggcatggctcaacactcatctgcttcaggcatcagcaaaagcacaaggaacttcttctcatgacgactacctcgcactgatatttcgtgcacaatacttactcaagggaatgggaagggcacggagtcttgtagtgccacagttgcaatatgatgtgtatcgcaacctcatcagtcaaatggctcgggtagctgaaagctatgaccagtcacttaagcaacttcaactctttgttgcccaaaacaagattcttggaggatacttgctagagcagaatagggcctttgctgccaaggaaagagatatggaagtttttcattctgagcttattgctcaaaaagaacttgaactcaaaaacaccatggtgaagatggagcaattgagtttacaaatggagacgcagatagccgacatggatcaagccaaagaggacatggacgcaggattgaggagattccaaaatagacaagtggcgaatgccatgtttgcagtgtttcgtgctataggggcaatcgcacttacagttgtgactgctggtgcagctgctccagcagctatggccgcagctaagggggcagtgaccacagctggtcaagctgcccggggattggttagagttttggagattttggatgatttgcaggcagccatggaggtcttcaagctcataaaagatttagtggagtctctgcgagaagtgggtcagctagtggatgcacctgacatgccagatatgccaacagaggcagattggtccatttttgtgaacgagatcgagggagttgcagagcaaatgcctgaagaagtgtcggaggtatcagcatggaagacctcgtgcaagaacgtcgcagcagtgggtcgcgaattgatgactacttcggcttacatttcacagcttcaatatgacatcaaggtgcaagcactgctgcaagacattgccaacagacaagcagaccgcctatcttcaattcaagcagcagatctcactagctacacagaaatggtgacacaaatggacatgcgcaccacgcgcttactgatggagctgataaaggtgctagacatgcagaatgtagcacttatgtaccagtttctcacgccgccaacaccgatgaatgcgtggccagttactatggagacggtgtggggcatgttggtgcagcatgaacatgcagctgttcttgggttgatgagactagggccagcctttgacttcaagagaaccttcatagtgaaggaaattcctgtggatctgctgctgcatggcgaggattggcagttcgagattccggtaaacgaacgcactgtctttcccagcacatggtcgcaagtgcgcattcatcacttggaaatgaagtttgttggtagtaacaacattgatcatgaggggtctcaccaacctatcacagaaagtggggaggtctacattcttctgcaaggctcccgcgtcttccatgaccgcaacaagtccgagctgcttcattacgaggctgctgttcctcttgactatcactatgcctaccatctggaaacaggggaaaccactctctccaactccccctccaatgaattcattcgaactttcatgcgcatgactccattcacaacatggagactccgtgtctctgcctctgcccaagagaatcaaggccttgcctttcctaccaccacagttggcgctggtgacaccacccaaattgctgtcactttctctgtctctgccattcgagagatttctctctag

SEQ ID NO: 52 - DNA, 2691 bp, Polypodium punctatum 'Serratum'
atgcacccgacaggtcatgacggaatcagcaatatccccctggagcagtgccatgatgactatgcggaggagaggcagatgaagccaaggttcgagaccaatggtctggagctggactacgagaaaatttacgcagggtcaaactcgatagcaagggaggtgggtctggacaaggtaaattgcggcgaggtcatggccatccaccagatgtttttcaggctggacaccttatcccaagagctgttgcggcgaccggagctggttaagcgtctcattgtggtcgctgatgtggtagagattgagggctctaatgccacactctcgctgcccggctcatctcttgtgctcatcttttgccgcatcctcatcctcaaaagcaggaacttagtcctcgaccttgacaattggaatttgagggctgcttccactactccgcttcatcgctgctccattcgtgctcaacgagttgtcattgcttcgggcttcagcctctattcctctctcctcattcaggtgaaacataaatttgaatggagcgatggcactcatcttgatcagtattttggacgtccattctacttcactgcaattgggatcaactcttctgctacaatcaccactacggctacctctgctatgcggtcaatcaacacttggccgggtacggcacctgtatctaacttcattcgagtgaactcggaaaagttcaatgtgcttgtaaacgcagtcccatggaagggtgtcatcgactgccaagcagcattgccttcattagatgatctgctgcatcctgatgtcattagtggcttccaatccaccctacttattgtggaaaccatccttaactttcagactgacaatccggccattatttcactcgcacgacaacatgctgaatggattctagacagcttacttcaggtggtgcctttgccagactctacattgggtgttcctgaggcaaaaactcttttggcgcgtgcacaaatcctcatgaagctgcccacggatggaagccagcatttaagagttccattactggcttatggtgagtaccaagaagatattgagcggctgcttagaaatgcagaggcgtacgaccaagaatacagagagctcacccgatttgtacagctagttgagatcatagggagcgagttcctgcagctgagcaggtctcttgcccaaagggagagagacatagaagcgttcgagtccttggctgtcattcgcaagcaaagtgagctggatcaggccattaggagaatgaactcattgatgccagagattgagagaagaagttttgagatggccgacgccaaagccaggatggaagagggtttggaggactacaacagaaggcagttgactagagcaatctttggaattctaggagctttactgcagctttgcgcatccctgaagtttggtggcggggctgacattgcggggggcatcgcaacaacagttcctgcagcaatagacctgatacatgcagtgcaagatacaagtgcaagtaccaagcttttggccatatcgcagaccttaatggatctagagaagatagttgatgttgtaaatgctgtgaacacgctagcggagagtgctacagagctggaggacatcgtacatgctccggagttgcctctcataccaccttatacatgggatatcctggagaacgacattgaggagtttgcagctctcatgcccttggaggtgtcggaggtggtaacatggaaggccaagtgcaggaacttagtcgcagtgtgcagggaaatttgcattgctgccagctttgcctgcgaggtgcaatatgagctctttgtgcatgcgaggcaacaggagatggcacggaggcaagcagaacggttggaaggaatgcaaacagcagccgacttgagcagctacatagagctggccacacaggcggacatgcgcactgcacgccttctcctaagcctgctcaacgtcctggctggtcatcagggggcactccactatcactacttgatggagttggaggtgttcacgtccagctggcctacagtcgacagcgtgaggacgcatttgctgcagctgaatcaaagggcccgtgcccgagagaacgcgttatttggcgatggagtccttactgtggatttgcagcacgactatgtgctggatgccatacccgtaagcctgctcttgtcaggcgaggattggaacttcacaatcaatccggagcgaaatgcatcgtcttttccaacaccgtgggattatgtgcgtattcggtacgtggagatgaggttcacgggagagcacctgccagtgagcgagacgggagagatctatctgttgctcagatcatctgccaacttccaggaccggttggaagagcaggtgctggagtatgaggccgctgttccgctcgtttaccagtatgcctacaacctctcgaccggggcaacgacactccccaatcaaccctccgagagtggcaaattctttcggatgacgcccttcacgcgctggagactgcggctctctgcatctgcataccagaaccagggcgtgtccttccccacgctccctggtgatccaaactctgatagccccgtccagattacaatcaccttcttcgttaccgcccttccacaaatacagtcacgctctctcgatatgtcagatggagatcctacagaggagtag

SEQ ID NO: 53 - DNA, 2724 bp, Polypodium punctatum 'Serratum'
atggcaagtatcacgtcaggagctggtgctgactggagggagctgtacagcgagatgaaccaggtgagcgagaggttgaggctggatcagctggagttctcagaagtgatgattatccaccgcatgcatatcaagttgtcggagctggatttggggcatctggaaggcgccgacaaggtgaagcatctgtatgtgtttgcggatgtggtggagcttgacaacgccgcggacccaagtacacctgtggacgtgagactgcctggatcaatatcggttgtgttcctgtgccgtgtgtggcacgtcagtcgccggcttactgtcggcgttaattctccgcaatactggcttcctacatttgacggacgaccggttaggatacagctcccccatgtgaaatggcatatgaacacgctcactagaagtatgcatcgcatagacccagaaacgttgcaggacctttcagggcctctcctctgtgtttatgcagatctcctacgcacctctctgcaccctcctgtcggacactccaattgggacgccgctcttgcatttccatccatgactgtgctacgagaagtcgaggttcttccttgtttcgatcattctacgccccgtcaaggcctcctcaccttgacgtcgaacgctgctccacaatgggtcaatcaattgagggcagcatttatcttcaccgatcaggatgccatgactgagatcctctcactgccagcagatgctagtgttatactcaataagaatcggccatcgattatattgacggcagggcaaagtggtgggtataccgatcgtaatgtgagtgcacccgcattctctgttctcagggagggcgcagaaactccaattgactctctcacagatccgaactttctacctgctatgcaaaccagcatgcttatcgcggagctagtggaggtcggtcggccctcagcagccataatcgaagtcatgcacaagcacgtggaatggctcaacaatctcttgcttcaggtgattgaagcaaagaaaggcaaggatgacgtagaggactacatccagctgtcgtatcgctcgcagtatattctaaagaacgtcggaaggatagatcgctttgtagtgccacagctgcaatacgacacatacagccctctcatcaatcgaatggcgcaggtagccgagagctatgaccaggcgctcagacagttcaggctcttcattcagcagacccagcagaacaagattcttggtgcctttttgctggaccagaaccgggcctttgctgacaaggagaaggacatggacattttctactccgaacttatcgcacaacggcaaattgagcttcacaacacgcttcagaagatggagcaactgagcttgcaaatggagactcaaagtgcagacatggagcaggcgcaagcagacatggaggcagggcttcggagatttcaaaatgaacgcgttgccagggctgtcttcggtgtacttggtgctattgcagcggttgctcttgccttcgtcacaggtggggcaactgctggtgcggccataggagcagccaagacagctgtgacactggcaggagcagcggcacgagggcttcaacaagtgctggaaatcttagatggcttgcaagcagtaatggaggttgtggggatgatcaaagaattgttcgaatccctgcaagaactgggtcaggcagtagacctgccagaaatgccagagatgccattggagtcagactggcacatctttgtgaatgaggtggaggcagtggcggagcaaatgccaacagaagtgtcggaggtagtcgcatggaaaaccaaatgcaagaatgtagcagttctgggaagggaaatgattacgctagcaacgtacatttcacagctgcaatatgacattcagatgcaagatatgctacaacagatcgccaggaagcaagctgatcggttgtcggctattcaactatcaatccctaataccggttacacagaaatgctgatgcagatggacatgcgcaccacgcgcttgttggtagctctgattagggcggtgcacatccagaatgcggccctaatgtaccagtacctgtcggagcccatacctgtgtctgcctggccagtaaacatggatgcggtgtggcgcatactcgtgcagcacgaacagtctgcaattcaaggcttgttgaggcttggccccgcttttgatatcgagcgcgtatttgtagtggaggacattcctgtgagcctgcttctggaaggagatgattacgaatttgatattcctgtagaggataacatcacctttcccttatccctttcacgtgtgcgcatccatcacctggagatgaagtttgtggcgagcggcggacaaaaacaggtccacatgcccgtcacggactccggctctgtgtacatccttctgcagtcatcacgcaactttcatgaccgcaacgagagggcagttgttcattacgaggcagccacatcattggactaccactatgcatacaacctagaaacaggtcagatcaaagtcacaaaccaaccctctgccgaattcaggaagaccttcatgcgcagtacgcccttcacaaactggagactgcgtctgtctgcctctgctgaagagaacaaaggattggccttccccaccgccacatccgcggacgctaccactcaaatcgtggttactttccacatttctgcagtcaggcaggtcgctttctag

SEQ ID NO: 54 - DNA, 2709 bp, Polypodium punctatum 'Serratum'
atggcaaatgatacttctagtggtattgtcgattggagagagttatatagagatatgaaccaggcgagtgatagaatacggttcaatcagcttgagttctcagaagtgatggtgatctatcgcatgcacatcaagatgtcagagttggatatgggacatttggagggttcagaaaaggtgaagcgcttgtatgtgtttgccgatgtggtcgagtacgacgctaatggaatagcaagacttcctggatccatttctgttgtctttttgtgccgtgagtggcatgtgagctaccatcttgttgctaggatggatagaaatcctccaagatatcagctcgatttggcgcaaggcgtgataatatcgcttccgcacatggcgtggcatctggatgtgcgtcgtcaaagcatgcatcgtctagacccagaaacattgcaagagtttttggagccttccttttgcgtgtatgctgatgacataagtgttgcctactatagtctcaatggagcctcgtgggaccccgcgcttcaattccctgatacagctgagttggcgaaatgtgcgcttctaatttacagtaattctaatcccacaccaaaccacgttcttctcacaagcaatcggttcaatggtacgcgttgggcctttagatttgaatttagcatgtattacattgacaacgaagatgtggcaaaagacattgcactgcagccaccaggcacccgtgtcatatttaaacgggaaggtcttcatttggttgtacttgcaatggattcggcgaatcgaatcatcagttttgaccctgaacgaggagatctagacgcttatatgcctgcattctctcttctcagacaggatgcaaagttcccgatcgaacttctcacagatccaaacattttatctgccatgcaaactagcatgctcatcggggaacttgtggaggtcggtaatccttcaactgctgtaactgaagttgtgcacaagcatgtgaaatggctcagcaaactcttgcatcaggtgatcgaggaaaagaacggcaaggatgtggaagattacatcgggctgtcgtttcgtgcacaatatgtaataaaaaaagtgggaaggatacgtggccttgtagtgccgcagttgcaatacgacgtgtatagcaatctcatcaatcgcatggctcaggtagccgaaagctacgaccaggcgctcaggcagttcaggctcttcattcagaacaacaagattcttggtggatttctgttggagcaaaatcgggcctttgctgagaaggagaaggacatggatgttttctactccgaacttatcacacaaaggcaaattgagctggacaacacccttcaaaagctgaaacgcctgagtttacaaatggaaactcaacaagcagacatggagcaggcacaagcagacatggaagcagggcttcggcgatttcaaaataggcaagctgccagggctctttttgccgtacttggtgctatagcagcggtcggtcttgccttcctcacaggtggggcaactgctcctgcggccttgggggcagccaggactgctgtgacagtagcaggaagtgtggtatcagggcttcagagagtcctagaagttttggagggtttacaagctgtaatggagattgtggtaatcatcaaagatttgttcagcgccctgcaagatttgactcaggctgtagacctgccagatatgccagagatgccattacagtcagactggctcatcttcgtgaatgaggtggaggcagtggcgcaggggatgccaacagaagtgtcggaggtggttgcatggaaaaccaagtgcaagaacgtagcggttcttggtcaggagatgactactacagcagcctacatttcacagctacagtatgacattatgatgcaagatatgctgcagcagattgccaggaggcaagctgaccggttgtcagccatccagctaccagaccttacaaactttacagagatggtcatacagatggacatgaggaccacacgaattctggtggctctcatcaaagtgatgtacatccagaacgcagccctcatgtatcaatacctatcagaacccacacctgtgtctgcatggcccgtgaacatggacacagtgtggcgcatgcttgttcagcatgaacaactcgcaattcaaggattactgaggctggggcctgcttttgatattgtgcgcacatttgtagtgaagagcattcccgtacgcctgctcctggatggagatgattaccagttcgagattccagtagaggaccccctcacatttccattatcattatcccgtgtgcgcatacatcacctggagatgaaaattgtgcaaggggcacacgtccacacccccatcacagccaccggcaaaatatacattcttctgcaaggatcgaggaacttccacgaccgcaatgaaggcaagataatgcattacgaggcggccaccgcgctggactaccagtatgcctaccagcttgacactggcgagaccaccgtcaccaacctgccatctgcagagtttctgagaaccttcacgcgcatgactcccttcactaactggaggctccgtttgtctgcctctgcggacgagaacgaagggctggctttcccaactgccacttccgctgatgccaccactgaaatcgccatcactttccatatttctgcaattaggcggatttctgactag

SEQ ID NO: 55 - DNA, 2661 bp, Polypodium punctatum 'Serratum'
atggagtatagcagcttgtatggtgatgtgaaccaagtgagcctgaggttccagaacatggagttctctgaggtcatggtggtgcatcggatgcatgtgcgcctggaggagcttgacatgacggggttggagggcatcgagaaggtgaaacgcctgtacgtgctggcggacgtggtggagctgccttccacagccacccaggtgtttcagtatctgcgccttcccgcctccatttcagctattatcctctgccgcgttctctatatccctgaagttgatcagaggccccacatggctcaatgctcgctcgacttcccgtttatgcgcctccatgtcgtcggatctgcacacgagaacggtgggggtgttatgcaagccttttcctccgacgccacccccagcaatattggcatctacttccatgctgaccgattcatctaccgccaggccacatcttcggccagcaactttgtcttgcccctggatgtaagggtcagctttggcagctctaccttctcggccccaaccctccgtcccgactggcaaaaccttaatgtctccaacatccagtacgggccgcagcatttgtccaggggcccacccctcacatcctcagactctgacttgcaaagatctgacgagatcgagctcctggcgcagcaagatgtttggagccctcttttacatgtcgcgttcagcccgaatgcaccacctggcaacatcccgggtacacaaggaattttccgaccctcctctgcatgcagctttttccatgtgccgccaccggatgtccctgcgaatgtgctcactgatccttccatcatcttgggcatgcaaatgaacatgctcattgctgagcttgtcttggctgctcacaattcgccgcaggtcatgaacgtcatcactaagcatgtgctatggctcaacaagatcttgcttcaggttgcttcacccaatgatgatattttagcactcttgtttcgtatccaagcattcatgaagatggcaaaggaaccgcggtttgtggttccacggttgcagtaccacatgtacggtagccttatcaatcgaatggtgcaagtagcccagaattatgaccaggagttcaagcaactgaagcttttcatcgcacaaaataagattttgggaagctatttgctacaacaaaatagggcttttgcagaaagggagagggaaatgagtgcttttcactcgcaagtcgtatcgatgaggagatctgagctgcagtctgccatacaaacaatggacaatttgagtttgcaaatggaatcagagagtgaggcgatgaacgaagcccaggagaacatggttgaagcaattcaagagtatgaaaggaaattacttgcaagagctctattttctgtgattggggcaatagcaagcgtcgctcttgcatttgccactggtggtgcaactgcaccaggggcagtggcagcagctggaggggctgttgctgcagcagggaggttggcagcagggctccaaaaggttgtggacatcctacaaggcttgcaagcagtcatggaggttgtggtagccataagagacatcgtagaatcattgaaaaacatgggtcaactagtagaagctcccgagatgccagagatgccaacggatgcggactggttaatttttgtaaatgaggtggaggcagtggcagagcaagtgccaacagaagtggcagaggtcccagtgtggaaggcgaagtgcaagaatgtggctgtgctagggcaagcaatgtgcaccacagcagcatatattagtgagctacagtatcagatcacggtggaagagatgctacaagagattgcacaacgccaagcagacaggttggtggggatatcagcagcagatctatcgagctacacagagatggcatcgcaaatagacatgcgtacaacccgaatcctccttgagctcatcaagatgttgtacattcaaaatgcagcaattaagtatgagtacttgtatgatgctaatgagaagcttaattcatggccagtgagcatggagactgtatggaccatgctcttgcaacaagagaatgcagctctcttgggcttgctagacttggggcccaccaatgatttcactgtaacctatgctgtgaaagatatacctaccaagttgttagtagatgggtttgattggaattttgagatcgcggtggaggattttgcaatctttccatcaggattgtctcgtgttcgcatacgatatgttgagcttaaatttgaccaacaaggtgctgatagtagtaacattgtcatccaccagcctagcactaacactggcttagtctacatgctcttacaaggctcccggttcgtccatgaccgcaaacgtcaggaggtgatggactatgaggcaagcacgggacctgtatatgcatatgcctatgacctcaacactggtgcaaccactctcaacaacatcccctcacagcaacaggccaacacatttatgcaaatgacacccttcaatgcttggagacttcgcctctctgcctctgctgccgaaaatcagggattggtgtttcctacagcaacttctccggacaatactacccaaatttccatcacattctatgtcactgctattcgacgcatagatcttcgacaagagggtgatgtggagtaa

SEQ ID NO: 56 - DNA, 2442 bp, Adiantum pedatum
atggccgatatcgattacagtgtgctgtacaacgatgtgaaccagatcagcatcaggctagagaggatggacttctcggaggtgatggcggtgcaccgtatgttcgtccggatggacgatctagacgtgagctccggcaccggagtgttggagggagcgcagaatgtgaagcgcctgtatgtgtttgcagatgtggtggagctgccttccaaacaagtgcggctgccgggctctgacatgatcgtcatactgtgccgtatcttcgtccgaaacggccgccataacactgagctgtttctgccttccatgaacatgagcatggtcgcagctggcaatgggaccattcggggagtgaacctgagcactacaatgtcgtcatcgtcatccaacgctttgcagttcaatttgcgaagcggttcgatgacatcgaccgtgcggctcaaagacgtggatgtggccgccgcactcacttgcgatgtgcaggctgcgtcggcgtcaatgcccttaactgtcatgacaaccggcacgtcgcctggcaacatctgggttcttggcatgactacagccgttgtcattccagaaagtgccgtggctgtcatcactgatgccaatattctgttgggcatgcaggtcaccgtgctcatcgccgagctagtcaagactgcccacaactcagatgtcatcatagccgctatcactaggcatgtggaatggttgaaccacctcttggttcaggcgcatgcagctgcccccaatgaggatgttatcacactcttgtatcgtactcaagctttcattaaactgaaaagagaaggcttagttgttccgcggttgcaatatcacatgtacaaaaacctcattgatcgaatggtgcaagtagctcagaactatgaccaagacttcaggcaattgaagctgtttgtggagcaaaataaaatacttgggagctatttgttagagcaaaacaaggcatttgctgaaaaggaaaaggacatggatgcttttcactcccaaatcattgctctaaggaccactgagctaaataacaccattgaaaggatgggtgagttaagcaaacaaatggatcaagagaatgaagcaatggagcaagccaaagcggacatggatgcaggcttgatagagtaccaaaacagacaagttgcaaatgctctctttgctgtcttgggtgccattgctagtattggtctggcatttgcaactggcggggcaactgctcctggagctgtgtctgccgcaggagcagccgtaactgcggctgggaaggcagctgagggattgaagaaagtagtagagattcttgaaggcttacaagtggtgatggaggttgtggctgccataaaagagctggtacaatctctacagcaaatagggcagctagtggatgcccctgagatgccagatctgccttcgaatgcggattgggagatttttgtgaatgaagtggaggcagtcgcagagcagatgccaacagaggtgacccaggtcgctgcctggaaggccaagtgcaagaatgtggcagccttgggccgagagatgagcacaatggcggcacacattgcagagctgcagtaccagatacaggtgcaagagatgttgcgcgagatcgcacaaaagcaggcagataggctgtcttccatcagtcccgcagacttgacaaactacctggagatggtgtcacaaatggacatgcgaacaactcgcatgttgttggagctgattcgagtgctttacatccagaatgcagcattgcagtatgagtatctacagacaccagccccattgaatgcatggcctgtggcgatgcaaacggtgtgggggttgcttatacagcaagagactacggccattactgggttgctgcagctgggggccccttctgacttcacacaagaatatgtagtgaaagatatccctgtgagcttgttgctagagggacgagactgggagtttgagcttccagttttgaatgctgatttcccctccacttggtctcgagtgcgcatccaccatgtggacatgcaattcgacgcagcagctacaagcatccatatacccaccaccaacactggagtggtctacctcctcctccaaagttctcgcttcttcgatgaccgtgccaggcgtgcaaacgagtttattagctatgaggcaggcaccggcctattctatcagtatgcctaccgcctcgccaccggcgaggccaccgtcaccaacatccccaccgacgagtatgctaatactttcatgcgtctcacacccttcacgcgttggcgacttcgtctttctttgtctgctgaggaaaacgcaggtcttgcattccccacagccacatccgcagatgacaccacccaaatcaaaatcaccttccatgtatctgctattaggcgtataagcacgcgcagtgacggtgtttcatcctaa

SEQ ID NO: 57 - DNA, 2649 bp, Adiantum pedatum
atggcggcggcagctcgggagtacagcgagttgtacaaagatttgaaccagataagcgagaggattaggttggatcagatggagttctcggaggtgatggtgatccaccggatgtttataaggctggaggagctggacttagggcatctcgaaggagcggagagggtgaagcgcttgtatgtgtttgcagatgtggtggaggtggaagaaggtggcaacttcattgaaacagggccgttagcgagactgcctgggtcgatcatggttgtcatactatgtcgcgtcctgagcgtgagagtcctcatgtttgacaatggcaataatgccatgcgcctgcagctcccgcacatgaagttgcgtgtggtggagatcacaacccagcccacaactaagctgcagatacatcgtgcagatgcagaagattatcaatatcctgccctctgcatacatgccgatgtcatacaggcctccatccgtctcagcagcagctccaatcgtcccccaatggatctccgattctttaactttaggcccaacagaggatccgacaacgtcgttttctcctccgaatctcggtccctgattgatgagcctgtcgaaatcttctatgtatactcccatatccctcgatttattcatgcacttcccatcccggaggcggccacagttgacccggcatcgcgatccaacgattggtattatgtctctctcagacgtgtgaactctacgttgtcgagctctgttgcggctgaaggagagctagaaccggcattctcactattgaaacccaaaatccccgtcgtcgtactcacagatcctaacattttgctcgctatgcagaccagcctccttatcgcggagctagtggaggtcgctcacccttcagcagaaacagctgatgctgtagccaaacacgtggaatggctcaacaaaatcttgcttcaggccacgaaggtggaagggatattaaattcatctcatgatgagcatctcgcgctcttattccgtgcgcaatacctgatgaagatgaggccagggaggacacgcaacctcgtagtaccgcaactgcaatatgatgtttatagcaatctcgtcaatcgaatggctcaagtggccgaaagctacgaccaatcactaaggcagtttaaactcttcattgaccaaaacaagattctcggaagctacttgctacagcaaaataaggccttcgctgacaaggaaagggatatggatgtttttcattctgagcttatttctcaacggaagattgaacttgataacaccatactcaagatggatcaattaagcttacaaatggagtctcaaagagaagacatggaccaagccaaaaaggacatggatgcaggattgcgggaattccaaaatcgacaagttgcgaatgctatgtttgccgtgatcggtgctatagctgccatcggtcttgccttcataactggtggtgccactgctcctgcagccgtgggagcagcaaagactgccgtgacagcagcgggtgcggctgcacgggcgctggaacgagtcgtggaaatcttggattccttacaagcagtgatggagatcgtctctatcataaaggaactggtgagttcgctgcaagagataggtcaacttgtggaggcaccagatatgccaccgatgccgacagaggcagactggttcatttttgagaacgagatagagggggtggcagagcagatgccaacagaggtgtcggaggtatccgcgtggaagacgaagtgcaagaatgtggcagtgttgggccgggagatgataactacggcaacttacatttcggagctgcaatacgacatcaaggtgcagggcatgctgcaggagattgccacaagccatgcgaatcggctgtccagcatccaagcaacggatctgagcaactatacagagatggtgacgcagatggacatgcggaccacgcgaatgttggtggcactcatcaatgtggtgcacatgcagaacgcagcgctgatgtaccagtgcctatcgccgcccacatatgtgaatgcatggccagtgacaatggagacggtgtggagcatgctagtgcagcacgagcatgcggcggttctgggattgatgaggctagggccctcctttgatttcatgcgcacatatgtggtggaggggattcctgtgcagctgctgcttgatggggaggattgggagttcgagatctcagtggaggattacacaacgttcccgtccacctggtctcgagtgcgcattcatcacctggaaatgaagtttgtgcaagccgcagatgtccatcagcctatcactgatactggcaaagtttacatgcttctccagggctctcgcatcttccgcgaccgcaaccgagccgacgccattcggtacgaggctgccatgtcgcttgattaccactatgcgtaccgcctcgacacaggagagaccaccctctccaatctcccctcccaagatttcacacgaactttcatgcgcatgacgcccttcactaactggagactccgtctctctgcctctgctgaagaaaacaaagggctcggctttcccactgctacatctgcgggctccactacccagattgcaatcattttctatatctccgctatcaggagaatttctctctag

SEQ ID NO: 58 - DNA, 2667 bp, Adiantum pedatum
atggagtacagtgccttgtatggtgatgtgaaccaagtgagcctaaggttcgagaagacggagttctcggaggtggtggtggtgcatcggatgcacgtgcgcctggcggagctgaacgtcaccttgggcgacaacaatatattgctgcagggcagcgacagggtgaagcgattgtacgtgctggcggacgtggtggagctgccgcccattttctccacctccatgagtctgccgggcaccgtatcggtggtaattctgtgccgtattctttaccttccttacctcgaagatgccagctctgccagcggctgggctgtgcatgctgcgctcttgcgcctgcgcgtcgtcgagatgcacgcaggttttgcccaagtcttcaccataccagcaaacgatagcagcgccgctgcgccagcggacatcggcctctacattcatgccgaccgcatcatctaccgcgacgaccccggccgcagtatcccggttattgaagtgcgggtagggggcgattccagattttcccccttcctgcccggctcgccggagatcaggctctccagcgtgcagtacgtgcgcgaattctccaaaggccagcctgtggctccagaagactccgaattgcagagatccgacgagatcgagctcatagccccctcagggtccgagcaacaacttagagctgcatttggtgcttctgtcggtatgaacctcttattccacttctcctcttcatttgacatcttgtcccttgatccggttcctgcagccctactcaccgacccaaatatcatcacgggcatgcaaatgaacatgctcatcgccgagcttgtcctgacagctgctcacaattcgccgcaactcatcaaagttgtcaccagacacgtggaatggctcaacaagatgtttcttcagcttgcgtctcccaatgatgatattctagcactcttgtttcgtgtgcaagcctaccaaaagatggccaagcaaccacaccccgtggtcccacgaatgcgttatagtaggtacgaaggccttatcaaccaaatggtgcaaatagctcagagttatgaccaagacttgaagcaactcaagctcttcattgcgcaaaatgagatccttggaagctacttgttagaacaaaataaagcttttgcagctaaggagaagagcatgagtgagtttcatttgcaagtgtctgatctaaggagaagtgagctcaacgacgccatacaaaagatgaccggcttaggagaagaaatggaggttgagaaagaagcaatggaccaagcctataaggatatggaacaaggattgcaggaatatgaaaagcgacaaattgtaacagccgtctttgctgttattagtgcaatatcactttgtgctcttggatttgtgactggtggtgcaactgtagcagcggtgccaggggccgtcgcaaatgcagcacaagctgttagtgcagcagttagtttggcaaacaagctacagaaagtgatgggaattttggaaattataaaccaggttgtgcagactgcggcggccataaaagaagtgattgaattatttgacaacatggggcaactactagaggcacccgagatgccagagatgccgtcgaattacgactggttaatttttgtgaatgaggtggaggcaatggcagagcaattgcccgtcgaagtgaatgagaggatcgtgtggaaggccaagtgcaagaatgtggcggtgctaggccaggagatgtgcaccacaggctcacatattgcagacttacaatatcagataaaggtggaagagatgctccgggagattgcacaaagtcaggcagaaaggctagaaggtatatcatcagcagatctttcaagctacacggagatggtgtcgcaaatagatatgcgcacaacgcggttgctgtttcagctcatcaaggtgttgcacattcagaatgcagcactcaagtatgagtacctgtatgctgctgatgagcaccttgtttcatggccagtgagcatggagactgtatggaccatgctcctgcaacagcagaggttgagtctcttgggctgggaaaatctggtgggcactaataacttgcctaatgatgacacacgcacctatgttgtcaaagacatacccgtcgaagtgttgcttagcggtcgcgattggccatttgtgatccatgaggaggattacaccgcattcccgtcgggatggtattatgttcgcatcaaccatgttgagctcaaattcgagcagcaaacagctggatcgacagatattgtcatccaccaacctagcaccaacactggcagactctacatgctcttacaaagctctcgcttcttccatgatcgcaatcagggtgtgaagatggagtatgagggaagcaggggactttcatatccctatgcctacaacctcaacaccggagagaccactcacaacaacatcccctccgaccagtttaagaacattttcatgcaaatgacacccttcactacctggagactgcgcctctctgcctctgccgaggaaaatgagggcttggtgttccacccaccatccacttcgcctacctctactacccaagtttccatcacattccatgtcactcgcattcgacgcatagatagattcactagtactgttcaccaaaaacatgcttcttaa

SEQ ID NO: 59 - DNA, 2694 bp, Platycerium bifurcatum
atggcggcagcacgtagtgcaggagccaatgaggcctggagggaggtgtatcacgatctgaaccaggtgagtgacaggataaggttggatcagctggagttctcagaagtgatggtggtccaccgcatgcacatcaagatgtcggagttggatttggggcatctggagggcgcggagaaggtggagcgcttgtatgtgtttgctgatatggtagagtgtgatgtgccacctcatgcgtcatcgtctgatggggatctggtgattcgactgccggggtccttgtccgttatatttatttgccgtgtgtggcacatcaacgttggcgttgtgcaacttactagtaccgtccaaatgtccaggactctgatagtacagctcccgcacatgaggtggcatgtcaatgcgactactggtagtatgcaccgcctacaccctcaaacttcgcaagaaggtccagacacttccttctgcgtgtatgcggaggttgtacaggtcgcctattaccctgatgtaacattctcagagttcgacggctcgcctacccttcgctttttgcggcttgagttcgaatcggatcagctccgtgtcaccacccaaactgaaggtccaatctgggcgattcgggccagtttagacactactatgacaccagacaatgatggccttctgaatgagatatcagcgcagccagcgggcaccattttcaaactgaatatattgccggacaacctgatcgtttcattatttggaagtctgagacccaattctagtacatcactaacccgggttccagacaaccttctacctgcgttctctattttcagagagaaggcagtagaacttctcacagatcctgacgttttgtctgctatgcagaccagcatgcttatcggggaacttgtagaggtcggtcagcctccagaagcaacaactgaagttgtgcgcaagcatatcgaatggctcaacaatctcttgctgaaggtgattgaagctaagcaaggccagcatgtggaggattacgttgaactatcgtttcgtgcgcagtatgtaataaagaatgtgggaaagatacaacgcatggtagtgccacagttgcagtacagcgcatacagcaatctcatcaatcgaatggctcaggtagctgaaagctatgaccaggcactcaggcagttcaagctcttcattcagcagaataagatcctcggtggatttctcttggagcaaaatcgggccttcgctgagaaggagcaggacatggacgttttctactccgagctcattactcaaaggcaaattgaactggacaacactcttcaaaagatgaaacatttgggcacacagatggacactcagacagcagacatggagcaggcacaagcagacatggaagcaggcgttcggaaattccaaaatgaacaagttgccaggggccttttcgctgtgcttggtgctataggagcagttggtcttaccttcctcacaggcggggcagctgctcccctggccatatcaacggccaggagggctgtatcagtagcaggggcggtggcgcaagggcttcaaacagtgctcgacatcttggagggcttgcaagccgtaatggagatcgtgcatctcatcaatgatctgatctctgccctgcaagagttgggtcagcctgtagagctgccagaaatggcagacatgccaacggaggcagactggctcatctttgtgaatgaggtggaaggcgtggcagagcagatgccaacagaagtgtcggaggtagttgcatggaaaaccaaatgcaagaatgtagcggttctgggtcgggagatgacgactctagcagcctacatttcgcagctacagtatgacatcgaaatgcaacacatgctgcagcagattgcccgaaagcaagctgatcggttgtcagccatccagctgccagaccttaggaactatgcagagctggtgacacagatggacatgcggaccacgcgcttgttggttgcgctcatcaaggtggtgaacatccagaatgcagctcttatgtaccagtacctctctgagcccacgcctgtgtatgcatggccagtgaacatggacagtgtgtggcgcatgctcgtgcagcacgaacagtttgcaattcagggcttgatgaggttgggtcccgcctttgatattgtgcgcacatatgtagtaaagagcattcctgtgagcttgctcttggatggagatgattatgagttcgaaattccggtagaaaaccacatcacatttccattatcattgtcgcgtgtgcgcatccatcaccttgagatgaggtttgtgcaggatggggatactgctcagggggcacatgtccacatgccgatcacagacaccggctctatctacatccttctgcagggatcacggaacttccgtgaccgcaatgagggcgcaatccttcattatgaagcggcaacaccactggattatcacttcgcctaccgcctcgacacaggggagaccactgtcaccaacctgccctctgctgagttcctgacaaccttcatgcgcatgacacccttcactaattgggggctccgtgtgtctgcctctgcggaggagaacaaagggttggccttttccacggccacatccgccgatgctaccactcaaattgccatcactttcttcatctctgcaatcaggcagatcgcgctctag

SEQ ID NO: 60 - DNA, 2688 bp, Platycerium bifurcatum
atgcacccgagagcccatgatggaatcagcatccccctgcagcagggcgatgatcacgatgcagaggagaggcagatatcgcaaatgaggccgaggttcaaggccaatgttgtggaggactatgaggaaatttacagagggtcaaactcgatagcgagggaggtgggagtgagcaaggtgaattgtggcgaggtaatggccatccaccggatgtttttcaggctggacaccttatcccaagagctattgcggcaaccagagcgtgttcagcgtctcatcgttgttgctgatgtggtggagattgagggctctaatgacacactctcgctgcccggctcctctcttgtgctcgtcctttgccgcatcctcatcctgaaaagcaaggacgtggtcctcgacctcactagttgggatttgacggttgccaccacaactccgctgcatcgctgctccattcatgctcaacgagttgtcgttgcttcgggctccctctctgcctctctactcattcaggtgaaacacaaatttgaatggagcgatggcactcatctggatcagtattttgggcgtccattctccttcatcgcatctgagatcaactcttctgctacagctaccactaggactaactctgctatgcggtcaatcagcacctggccgggtacagcacccgtgtctaacttcattcgagtgaactctgaaaagttcaatgtgcttgtaaatgcagtcccatggaagggtgtcgtcgactgccaagcttcattgccttcattagatgatctgctgcatcctgatgttattagtggcattcaatctaccctacttattgtggaaaccatccttaactttcagactgacaatccggccattattatcctcgcacaacagcatgctgaatggatcgtggatagtttacttcaggtggtgcatttgccagactctacatttggtgttgctgaggtaaaaactcttttggcccgtgcgcaaatgctcatgaaattgcccacggatggaagccagcatttacaagttccattactggcttatggtgagtaccaagaagatattgaccagctgcttagaaacgcagaggcatacgaccaagagtatagagagcttacccgattcgtacagcaagttgagatcataggcaacgagttcctgcagctgagcaggtctcttgcagaaaaggagaggcaaatagaaatctttgagtcattggtcgtcattcgcaagcaaagtgagctggatcaggccatcagaaggatgaattcattgatgacagaaattgagagacgaagttatgagatggcggacgccagatccgagatggaacagggtttggaggactaccacagaaggcaattgactagggcaatctttggaatcctaggagctttactgcagctttgcgcatccctgaagtttggtggaggggctgacattgcggggggcattgcaacaacagttcctgcagcaatagacatgatacatgcggtggaagatgcaagtgcaaataccaagcttttggccatatcgcagagcttaatggatctagagaagatcgttgacgtcgtaaatgcagtgaacgcgctagtggagagtgccacagagctggaggacatcatacatgctccggagttgcctcttataccaccttatacatgggatatcatggagaatgacatcgaggagtttgcagctcttatgccctccgaggtgtcagaggtggtaacatggaaggccaagtgcagaaacttagtcgcagtatgcagggaaatttgcatagctgccagctttgcctgcgaggtgcaatatgagctctttgtgcatgctaggcaacaagagatggcacgaaggcaagcagaacgcttggaaggaatgcaaatagccgccgacttgagcagctacatagagctggccacacaggcggacatgcgcactacacgccttctcctaagcctgctcaatgtactggctggccatcagggggcactccactatcactacttgatggagctggaggtgttcacgttcagctggccttcagttgacagcgtgaggatgcatttgctgcagctgaatcaaagggctcgtgcccgagagagcgggttatttggcaatggagtccttactgtggatttggagcacaactatgtgctggatgccatacccgtgagcttgctcttgtcaggcgaggattataacttcacgatcaatccagagcgaaatgcatcgtcttttccgacgccgtgggattatgtgcgtatacggtacgtggaggtgaagttcacgggggagcaccagccagtgaccaagacgggagagatttacctggtgctcagatcatctgccaacttccaagaccggttggaagagcaggtgtttgagtatgaggctgctgttccgctcgtttatcaatatgcctacaacctgtcgaccggcgcaacgacactccccaatctaccctcccagagcggcaaattcttccgcatgacgcccttcacgcgttggagactgcgtctctctgcatctgcataccagaatgagggcgtttcctttcccacactccctgatcttccaggcgcagctgatagccccgtccagattacaatcaccttttacgttactgcccttccacaaatacagacgtcttcaactgatcaagaccctgcctcaacaacatag

SEQ ID NO: 61 - DNA, 2721 bp, Nephrolepis falcate
gagatagagacagagaaggttttaattgtatgcgaacgagttgcttatttgtttttaggcgggtggggtgcgtgttctgaagctccatatcgcgcaatcggtatcctgagtgccgatcaaaatccacacgagatattcaccatgggaggagcggtgcccgactatagccatctgtacagggagctgaaccaggtgagcgagaggataaggctggaccagatggagttctcagaggtgatggttatccatcgcatgttcatcaggcttcctgatttgaacatagcccatctagaaggtgctggccaggtcaaacgcctgtatatcttcgctgatgtggtggagctgggaggccatctggtgacgacgcagctgcctggaaccgtgatggtcgtcatcctgtgtcgtgtactctccttgcgtagtcccacggcacgctatggtttgaactttccccatatgaggctccatgccgtttttcagagcgcatctcggatccttcacatgcatcgacttattcctgattctgcgcaatatgatgcttatccagtcgtttgcgtacacgcggatgccctagagttctctggtacaagcactggaggaatatttcacattggtccgctgcgataccccagtatgatcgttacctctgagagccattctgcagtggatgctcaaatatcgtctttctcttgtaatgttagtttacggtccgcgtcagcatcttcccctcttaaaattaaccccgacaatgtgagctttcaatctatgttcaacctagttacgggtggtggcttcggttttgccgtgcgacctgaagagttctggttactccgaagagatctgccagatgccctactaaacgattcgagcattctgctgtgcatgcagaccagcatgcttgttgccgagctagttgagttcagtcatccttcatcggaccttcatgcggctataatattgcacgcagaatggctcaacacccttctgcttcaggcatcggcagcatcacaaggaacctcacatcatgatgattaccttgcacttatatttcgcgcgcagtacttgatcaagggagttggaagggcacgaggcgccgtagtgccacaattgcagtatgatatgtacagcaacctcatcaatcaaatggctcgtgcagcggatacctacgaccaatcgcttaaacaatttcagctctttgtcgcccaaaataagatccttggaggatacttactagagcagaatagggccttcgctgctaaggaaagagacatggaggtctttcattctgagctcatcgctcagaaaaagaccgaactccaaactgtcatggtgaagatagacaaattgagtttacagatggacacccaagtagcggatatggagcaagccagagaggacatggaagcaggattgaggagatttcgagatcggcaagtagcaaatgccttgttctctgtgtttcgtgctataggtgcagttgcgctcacagtgttaactggtggtgcggctgctccactggccatatctgcggcaaagggggccgtgagcattgctgggcaagctgccaggggattggagagagtcttgcagatcctcgatgatttacaggcggcaatggagcttctgaagatcataaaagatctagtggagtctctgcaggaagtaggtcagctggtggatgcacctgaaatgccagacatgccaacagaggtggattgggccatctttgttaatgaggtcgaaggagtagctgagcaaatgccggaggaagtctcagaggtgtctgcatggaaaacgtcgtgcaagaacgtcgccgtggtgggtcgtgaactgacgacgacttcagcttacatgtcgcaactccaatatgacgttcaggtgcaagccatgctgcaagatattgcgaggaaacaggccgatcgcctgtcttcgattcaagctgtggatctcagcagcttcacagaaatggtaacgcagatggacatgcgcacgacacgcttactggtggagctaataaaagtgctagacatgcagaatgtagcactcatgtaccagtctctcattatgccagagccaataaatgcgtggccagtgacaatggagacagtgtggggcttgctgatacagcatgagcatgcagctgtactggggttgataaggctgggaccatccttcgacttcaggagaacttttacagtgaaggacattcctgtggatctgctgctgcatggtgaggattgggagtttgaaatccctgtggatgacttcacagtcttcccggtcacatggtcacgagtgcgtatccatcacttggagatgaagtttgttggcactgatgaggctgcaccagcgccagggctgcaagggactcaccagcccacaacaaaaactggggagatctacattctcctgcagagctctcgagttttccatgaccgcaataacacaaaacctcttcactatgaggccggcgtcccgcttgactaccactatgcctacaatctggaaacaggagagaccacactttccaacctcccctcttatgacttcatccgagcttttatgcggatgacgccgttcacaacatggaggcttcgggtctctgcctccgctcaagagaatgaaggccttgcctttcccactgccacagccggcaacggtgacaccacacagattgctgtcactttccatgtctctgctattcgggaaatcgctctctga

SEQ ID NO: 62 - DNA, 2619 bp, Nephrolepis falcate
atggagtatagcgatctgtatcatgacgtgaatatgctgagcttgccgctgcataggacagagctatcggaggtgatggtagtccaccgcatgcatgtgaagctgagagacctgaacctggaaacggcagtcagcgacaaggttcaccggctgtacgtggtggcggacgtggtcgaggtgacgttagacacagtgagcctgccgtgtaaggtgtcggtggtcatcctctgccgcgtcctgcacgtggaacaatcgtcagttctgttcagcagcctccttctgcccaacatgaacgtgcgtgtggtattgtctaataataggatgcaagtctatcccatggctacagacggcagcgcggatgatgtcgcactgtatattcacgccgatcgggtgatcaggcggcagggtgcgtggacattggtgagggtgatgcacatgtctataaccgggccggagtccaccttctctgttccacatctgccggatccggcgttgttcaacagagtgatggtaaatgtccagatggacgctgggcccagcatccctgcgtctgagtcagacctgcagcggtctgatgagactgaactggtaagcagggtttcaaatggagtgaccgtttctgcgagcatcgcgggcagcgcctggaccatgccggccgacaacccctctgctacattcactgtctttccaaatccgcccgcacagcctgttgctcgcggggtgctgaccaatccttatgttatcattggcctgcagatgaacatgctcactgccgagctcgtccaggctgcccacaatgctcccctactgatccgtgctgtgaccagacatgtggaatggctcaacaagatcctagttgaggcattgcaggttgtctctggcaacgaggatctgttagcactgctgtttcgtacagaaacgtatttgaagatggccacagagtctcgttccgtggtcccccggttacagtaccacatgtatagtgacctcatccacagaatggtgcaggtggctcaggcttatgacgacgaatttcaacgactcaggctcttcatcgcacagaatgagatcctgggcagctacttgttagaacagaataaggctcttgctagtagggagagggaaatgagcgcttttcactcccaagtggtgtccctgaggagaaccgagcttgacaactgcttacagagaatggaccagttaaacgtgcagatggaaagagagaataaagcaatggaggaagctcaagagaagatgaatgaagctcttgaggcacatcagagaaggggacttgcaagagctctttttgctgttctcggagcaatagcagcagttgctctcacggttgcgactggtggtgctgcagcaccagcagctgtggcagcagctgggcaggcggtgacagcggcaggaacattagcacaagggttaaagacggtggttgaaattttggaaggcttgcaagctctcatggatcttgtcgtcatcataagagagcttgtggaaaatttgcagaccattggccagctcattgatgctccggagatgcaggaaatgccatcgaatgcagactggctgatttttgtgaatgaagtggaagctgtagccgcacaaatgccggaggaggtgtttggatcagtggcggtatggaaggccaaatgcagaaatgtagcagtgctgggccaagagatgtgtaccatggcagcacacattgcagaattgcaacaacagataaagctggaagagctgttgcaagagatagcagaccgccaagcagatagattactgggtatatctgctgcagacttatcaagcttcacagagatgcttacacagatcgatatgcggactactcggttgctgcttcagctcatcaagctcttgcacattcaaaatgtagcaataaattatgaatatctgtttcctgccaatggacgacttagctcttggccagtgacaatgcatacagtttgggagatgctcttacaacaagagtcatcagctatcacgggtttgctggccttggggccatccacggattttgcaaggacctttgttgtccacgacataccagtcggacttttggttgatggttttgattggcagtttgcaattcctgtaatggacgattcttcggcctttcccattggtttctctcgtgtgcgtatacgccatgttgagctcaaattctctgcgattgatattgatgcgtccgcgactgttcaccagcctcgaactgacaatgggttcatctacattctcttacagagtgcccggtctttctctgatcgcagggtaaggcaggcaatggactacgaggcaagcgagggacttgcctacccctatgcttacaacctcaccacaggagtgccttctctcaccaaccttccgtcacaggagcatgccaacactttcatgcgaatgacgcccttcactgagtggcgacttcgtctgtcttcctctgctgaggagaataggggacttacattccccacagcaacttctcctgatgattccactcaaatttcaatcacatttcatatcaccgctattcgtgctatagatttccgcggcatggacgatgaggagcgcagtaaaagtgattcttctcagaagtaa

SEQ ID NO: 63 - DNA, 2688 bp, Nephrolepis falcate
atggagtacagtgatttgtatgcggatgtgaaccaggtgagcctgcggtttcagcagacggagttctcggaggtgatggtagtccatcgcatgtacgtgcggctcctggacctggacatgacgacggagccccacctccagatgctggcaggcagcgagaaggtgcggcggctgtacgtggtggcggacgtggtggagctgccggccacggcaaccaacatgcggctgcctgccactgcgtcggtcgtcatcctttgccgggtgctgtacgtgcaggacgtgaactctccttaccttgcctgtggcctgcacttcccgttgatgcccctgcgtgtggtggaggacacgcagcagggtagggtccatgtgtttccagtggtcggcggggaatcggcctctgtcgacaagatcgggctctacatccacgccgatcgtgtcgtctaccggcaggacacctctaccgccaacccccttcagccgttgcaattgagggtgatcggaaatggctcaacattctctaccgaggtgcgcccagactggcccaaaaccctagaggtcagttccctccttatgtggctcaccctgtcaaaggggcagcccattcctgcggcagaatccgacttgcaacgacacgatgaggtcgagcttctgtccccaccttcccccgacagactcagcgtagtttttgcctaccttgcacctgggaatctgttcagtatcgccgtggatgtggagtacatcggtgctgggttttgctacttccgcatacccccggcagatcctgtccccacagaagtgctcacggacccttacgtcatcatcggtctgcaaatgaacatgctcattgcagagctggtcctggctgctcacaattctccaccggtcatcagcgttgtcaccaagcacgtggaatggcttaacaagattctaccgaatgatgatattttagcactcctgtttcgtgtgcaactttctttgccgaatgatgatattttagcactcctgtttcgtgtgcaagccttcttgaagatggccaagcagcctcgatctgtggtaccccggttgcaataccacatgtacagtccccttatcaatcgcatggtgcaagtggcccaagtatacgatcaggagttcaagcaactcaagctcttcatcgtgcaaaatcagattcttggcagctatttgttagaacaaaacaaggcgtttgcaagcagggagacggagatgagttctttccactcccaagttgtatccttgaggagaacagagctcaacaatgcaatagacaggatagaccaattaagtgtccaaatggaaaatgagaatgaagcaatggaccaggccaaagaggacatgatgcaagctattgcggaatacgagaagaagcaacttgcaaacgctctttttgctgtacttggtgcaatagcgagcgtcgcacttgcatttgccacagcgggtgcaaccgcaccgggggcagtggcagcagcaggagcagctgtgagtgcggcaggaagattggcagagggcttgaagaaggtggtggaaatattagaaggtttggcagcagtgatggagattgttgcagccataagggacctagtggagtcactgcaaaaccttggtcagctggtagaaacaccagagatgcctgacatgccctcgaatgcagactggctaatctttgtgaatgaggtggaggctgtggcagagcaaatgccagcagaagtggtcggttctgtggcagtgtggaaggcaaagtgcaggaatgttgccgtgcttgggcaggagatgtgcaccaccgcggcacacattggagaattaacgtaccagataaaggtggaggaaatgttgcaagagattgcacagcgccaagcaaacaggctggagagtctgacaccagccaacttgtcaagctacacggaaatgctttcggagatagacatgcgcaccactcgattgctgcttcagcttatccggttgttgcacatccagaatgcagcaatcaagtacgagtacttgtatgctgcaggtgagcaactgaattcatggccagtgagcatggatactgtttggagtatgctcttgcaacaagagaactcagctctcgtgggcttgttggacttgggaccatctaatgatttcacacgcagctttgtcatccagggcatacccatcgggctcctggtggatggtaatgattggcagttctccatccctgtggaggattccccaacctttcccatcgggtactcacgtgttcgcatacgttatgtggagctcagattcgatcaaggcacgagtgacgagggcaggatgatccaccagccgagcacaagcagtggcttgacatacatgctgctacagagctctcctgtcttccgggataggaggaggagagaggtattggagtatgaggcgagcatgggactggcatatgcatttgcatacaatctgacgacaggagtgcccacactgaccaacgtcccatcccccgagtttgccaacacgttcatgagaatgacgcccttcaacagcaactggcggctgaggctttcttcctctgccatggaaaatcagggcctgatgtttcccacagcctcttctgccgatgataccacccaaataaccatcacttttttcatctctgccattcgcggaatagatacacgcgctgctgtagaaatatag

SEQ ID NO: 64 - DNA, 2682 bp, Nephrolepis falcate
atgcagcagagtgtccatattgccgcccgcatgccgggtgatggtgagaaaggtcgcttctcttcagacgaggagcaccaaatgatgatgagaccacggctcacgagcaatgttccggaggactacgaggcgatttacgcagggtccaactccataaccagggaggtgggggtgaacaaggtgagatgtggcgagctaatggccatccaccagatgtttttcaggttggacactttgtcccaagagttattgcagcaaccacagctggtcaagcatctcattgtggtcgcggacgtggtggagatcgagggctctcgcggcacgctcgtgctgcctggctcctcccttgtcctcatcttttgccgcatcctagtcctcaaaagcaaggacgtggtccttgatcttggcagttgggatttgagcgtggctaccacatcgtctcctctggttcgatgttccattcgcgctcaacaagtcgtcatttcttccggttccctttctgcctctttactcattcaggcgaaacatagactcaggtggagcgatggttctcatcttgatcagtatttcggacgtccattctccttcgcctcatccaagatcaactcttttgctacaaccaccactcagactagctatgctaagcagtcaatcagcacctggccgggtgtcccaccaacatctaacctcatagtagtgaattctgaaactttcaatgtgcgtgtaaatgcagtcccgtggaagggagtcgttgactgccaaactgcattgccatcatcagatgatctcctgcatcctcatgtcattagtggtattcagtctaccctacttattgtcgaaaccatccttaactttcagactagcaatccttccattatcgtcctcgcacaacaacatgcacaatggattgtcgacagcctacttcaggcggtgcatttgccaaactctacaactggtgttcctgagctaaaaacgcttttggctcgttcacaaatggttgtgaaattgccgatcgatggaagccagcatttaaaagttccattgctggtttatggcgagttccaggaagatattgaccagctgcttagaaatgcagaggcgtacgaccaggagtatagacagcttacccgattcgtacagcaagttcagatcattggcagcgagttcttgcagctgagcatgtctcttgctcaaaaggagaggcaaatagaaacgttccagtccttgcttgtcattcgcaagcaaagtgagctggatcagactatgagaagaattgactcattgatgagagaaattgagagacgaagttttgagatggcggatgcccgatacaggatggaagagggtgtactcgaccactacagaaggcaagtgaatagagcagtcttcggaatgctaggtgctttactgcagcttttcgcatctttgaagttcggtggtggggcggacattgcgggggccatggaaacaacagtttctgcagcaatagatataatacacgcggtggaagatgcaagtgcaagtagcaagcttttgcccatgacgaagaacctgatagatttagagaagatgattgaggttgtaaatgctgtgaatgagctagtggagaatgccacagagctggaggacatcatacacgctccggagttgcccatcatatcttcttatacatgggacatcctggagaatgacatcgacgaattggcagcactgatgccctctgaggtgtcagaggtggtaacatggaaggccaagtgcaggaacttggtcgcggtgtgcagggaaatttgcattgctgcaaactttgcagcagaggtgcaatacgagctgtttgtgcatgcaaggcaacaagagatggcacgaaggcaagcagaacgtttggagggaatgcaactagcaaccgacttgagcagttacatagagcttgccacacaggcagacatgcgcaccacacgtcttctgctaagcctgctcaatgtactggctgaccatcagggggctctccactatcactacttgatggagctgcaagtgttcacgttcacctggccttcggtcgacagcgtgaggatgcatttgctgcggctgaatcaatgggctcgtgcccgggagaatatgttatttgggcctggagtcctcactgtggaggtgcagcaagactatgtggtggatgccatacccatgagcttgctcttgtcaggcgaggattggagcttcacaattaatccagggcaaaacgcgtcagtatttccggcgccatgggattatgtgcggattcgatatgtggaaatgaagttcacgggtgagcatcatccagtgagccagacaggagaggtctacctgttgctccaatcatctgccaacttccaagaccgctttgaagggcaggtgctggagtatgaggctgctgtgcctctggtttaccaatatgcctacaatctcacaaccggtgcaaccacactgcccaatttacccttcgaaagtggcaaatttttccgcatgacacccttcacgcggtggagactccgtctatctgcctccgcataccagaatgagggcatctccttccccacagccaattcctcagatacctctatccagattaccatcaccttctatgtgactgcccttccacaaatacagagcttatcggaagaccctgcagtagctacaactctgtag

SEQ ID NO: 65 - DNA, 2577 bp, Colysis wrightii 'Monstifera'
atggaaagagcgatacctgactacagccatctgtacagggagctcaaccaggtgagcgagaggattagaatggatcagatggagttctcagaggtgatggttatccatcgcatgttcataaagttcccagatttgggcatagcccatctggaaggtgctgacaaggttaagtgcttgtacgtcttcgctgatgtggtggaacttggaagtgtgcggcagacctcgagcctacctgggtccattatggtagtcatcatgtgtcgtgtcctcaccttgcatcttgattcggctgcacaggcgtatcgaatcgacttgcctcatatgagactccatgctattaatgatgcacaacgccttcgcatccatcgacgcaattctgattctctgcatgatgattatccagtgattaccataagcgcaaatgtcatagagttctctgggacaagatctctacgagatatatttggtattgggccgttgcaggatcccagtatgattatcaccaatactgaaacacagccgcccgtagtggagaggcccagcatcaactccctttgtactgtgggtctcgtgcaggggcaatcatcctcccctgttacagttgacccagacaggataagccgtcacttctggtttcagtcggtcggtggcggcgctcttggtactctccgagctgcagaaggattctcgttattccaaagagatctcccggatgtcctactcatagatcccaacattttgctttgcatgcaaactagcatgcttgttgccgagctagtggagttcagtcatccgtcatcagacattcattccgctgtaacagagcacgtggtatggctcaacactcatctgcttcaggcatcgacaaaagcacaaggaacttcatctcatgacgattacctcgcactaatatttcgtgcacagtacttactcaagggaatgggaagggcacggagtcttgtagtgccacaattgcaatatgatgtgtaccgcaacctcatcaatcaaatggctcgagtagctgaaagctatgatcaatcacttaagcaacttcaactttttcttgcccaaaacaagattctcggaggatacttgttagagcagaatagggcctttgctgccaaggaaagagatatggaagtttttcattctgagcttattgctcaaaaagaacttgaactccaaaacaccatgttcaagatggagcaattgagttcacaaatggagacgcaaatagccgacatggatcaagccgaaaaggacatggaggcaggattgaggagattccaaaatagacaagtagcaagggccatgtttgcagtgtttcgtgctataggtgcggtcgcacttacagttgtaactggtggtgcagctgctccagcagctatgacagcggctaagggggcagtttccatagctggccaagctgccaggggattggagagagttttggagattttggacaatttacaggcagcgatggaggttttcaagatcataaaagatttagtggagtctctgcgagaagtgggccagctagtggatgcacctgagatgccagatatgccaacagaggcagattggtccatttttgtgaacgaagtcgaggcagttgcagagcaaatgcccgaagaagtgtccgaggtatcggcatggaagacctcgtgcaagaatgtagctgcggtgggtcgcgaattgacgactacttcggcgtacatttcacagcttcaatatgacattaaggtgcaagcaatgctgcaagacattgccagcagacaggccgaccgcctattgtcgattcaagctgcggatcttagtagctatacagaaatggtgacacaaatggacatgcgcaccacacgcttactaatggagctaataaaggtgctagacatgcaaaatgcagcacttatgtaccagtttctctcactcccagcaccgatgaatgcgtggccagtgactatggagacggtatggggcatgctggtgcagcatgagcatgcagctgttcttgggttgatgaggctagggccagcctttgatttcaggagaacttttgtagtgaaggaaattcctgttgatctactgctgcatggtgaggattggcagtttgagattcctgtaaacgagctcactgtcttcccgggcacatggtcgcaagtgcgcatccatcacttggaaatgaagtttgttggcactgctgaggggtcagctccaaatggggctcaccaacctatcacagaaagcggggaagtctacattctcctgcaaggctcccgtgttttccatgaccgcaacaagactgagccgcttcattacgaggctgctgttcctcttgactatcactatgcctaccatctcaaaacaggagaaaccacactctccaactccccctccaatgatttcattcgaacatttatgcgcatgaccccattcacgacatggaggcttcgtgtctctgcctctgcccaagagaatcaaggccttgcctttcccaccaccactgttggcgctggtgacaccacccaaattgctgtcactttatatgtctctgccattcgagagatttctctctag

SEQ ID NO: 66 - DNA, 2475 bp, Colysis wrightii
atggttatccatcgcatgttctttaagcttccagatttggacatcgcccatctggatggtgccgacaaggtcaagtgcttgtatgtcttcgcggatgtggtggaacttggaagtgcggggcagacctcgaacctacctgggtccattatggtagtcatcatgtgtcgtgtcctcaccttgcatgctgattggtctagaacgtcgtatcgattcgtctttcctcatatgcgactccatgccatttttgatctacagcaagctcgcatccatcgacgcaattctgattctgtgcatgatgattatccagtgattaccataagcgcaaatgtcatagaattctctgggacaagatcttcaagtgttttatttggtattggggtatttctggatcccagtatggttctctcctctgaccgacactccatagtggagaggcccagcagtcacaccctttgtaatgtgaatcccgtggaacaatcctcccctattatggttgacccagacaccatacggtttcaaagcattttcaactgggtcggtagtaatattatgtctcctcaagttgcccgagctccagaaggattctcgctattccgaagagatctcccggatcttctactcatagatcccaacattttactttgcatgcaaactagcatgcttattgccgagctagtggagttcagtcatccgtcatcggacattcatgctgcggtaacagagcacttgatatggctcaacactcatctgcttcaggcatcgacaaaagcacaaggaacttcatcttatgacgattacctcgcactaatatttcgttcacagtacttactcaagggaatgggaagggcacggagtcttgtagtgccacaattgcaatatgatgtgtaccgcaacctcatcaatcaaatggctcgagtagctgaaagctatgatcaatcacttaagcaacttcaactttttcttgcccaaaacaaggttctcggaggatacttgttagagcagaatagggcctttgctgccaaggaaagagatatggaagtttttcattctgagcttattgctcaaaaagaacttgaactccaaaacaccatgttcaagatggagcaattgagttcacaaatggagacgcaaatagccgacatggatcaagccgaaaaggacatggaggcaggactgaggagattccaaaatagacaagtagcaagggccatatttgcagtgtttcgtgctataggtgcggttgcacttacagttgtaactggaggtgcagctgctccagcagctatgtccgcggctaagggggcagtttccatagctggccaagctgccaggggattggagagagttttggagattttggacaatttacaggcagcgatggaggtattcaagatcataaaagatttagtggagtctctgcgagaagtgggccagctagtggatgcacctgagatgccagatatgccaacagaggcagattggtccatttttgtgaacgaagtcgaggcagttgcagagcaaatgcccgaagaagtgtcagaggtatcggcatggaagacctcgtgcaagaatgtagctgcggtgggtcgcgaattgacgactacttcggcgtacatttcacagcttcaatatgacattaaggtgcaagcaatgctgcaagacattgccaacaaacaggcagaccgcctgtcctcgattcaagctgcggatcttagtagctatacagaaatggtgacacaaatggacatgcgcaccacacggttactaatggagctaataaaggtgctagacatgcaaaatgcagcacttatgtaccagtttctcacactcccagcaccgatgaatgcgtggccagtgacgatggagacggtatggggcatgttggtgcagcatgagcatgcagctgttcttgggttgatgaggctagggccagcctttgatttcaggagaacctttatagtgaaggaaattcctgttgatctactgctacatggtgaggattggcagtttgagattccagtaaacgagctcactgtcttcccgggcacatggtcgcaagtgcgcatccatcacttggaaatgaagtttgttggcactgctgaggggtcagctccaaatggggctcacctacctatcacagagagtggggaagtctacattctcctgcaaggctcccgtgttttccatgaccgcaacaagactgagccgcttcattacgaggctgctgttcctcttgactatcactatgcctaccatctcaaaacaggagaaaccacactctccaactccccctccaatgatttcattcgaacatttatgcgcatgaccccattcacgacatggaggcttcgtgtctctgcctctgcccaagagaatcaaggccttgcctttcccaccaccactgttggcgctggtgacaccacccaaattgctgtcactttctatgtctctgccattcgagagatttctctctag

SEQ ID NO: 67 - DNA, 2655 bp, Colysis wrightii
gtgaaccaagtgagcctgaggttccagaacatggagttctctgaggtcatggtggtgcatcggatgcatgtgcgcctggaggagcttgacatgacgggggtggagggcatcgagaaagtgaaacacctgtacgtgctggcagacgtggtggagctgcctcccaaagccacctcggtgtttgagtatgtgcgccttcccgctaccatttcagcgattatcctctgccgtgttctctatatccctgaagttcagaggctctccggcgcgggtttccgtggtcaatgctcgctcgacttcccgtttatgcgcctccatgtcgtcggagctgcacatgagagcggtgggggtgttatgcaagcattttcctccgatgccaccgctggcaatattggcgtctacctccatgctgaccgcttcatctaccgcgaggccgcatctccggccagcgactttgtctggcccctggatgtaagggtcagctttggcagctctaccttctccaacaccgccgttcccgactggcaaaaccttaatgtctccagcatcaggtacgattcgcagcgcctgtccaagggcccacccctcacttcctcagactctgacttgcagaggtctgacgagatcgagctcctggcccagcaagatatttggagccctattctacatgtatcgtttaacccgaatgcaccacctggcaacgtcccgggtacacaaggactattccgaccctcctctgcatgcagtttcttccatgtgccgccacccgatgtccctgcaaacgtgctcactgatccttccatcatcttgggcatgcaaatgaacatgctcattgccgagcttgtcttggctgctcacaattcgccgcaagtcatgaacgtcgtcactaagcatgtgctgtggctcaacaagatcttacttcaggttgcttcacccaatgatgatattttagcactcttgtttcgtatccaagcattcatgaagatggcgaagcaaccgcggtttgtaccgcggtttgtagttccacggttgcagtaccacatgtacggtagccttatcaatcgaatggtgcaagtagcccagaattatgaccaggagttcaagcaactcaagcttttcattgcacaaaatgagattttgggaagctatttgctacaacaaaataaggcttttgcagaaagggagaaggaaatgagtgcttttcactcacaagtcgtgtcgatgaggagatctgagcttacgactgccatagaaacaatgaaccagctgagtttgcaaatggaaacagagagtgaggcgatgaacgaagcccaggagaatatggttgaagcaattcaagaatatgaaaggaaattacttgcaagagctctattttcagtgattggggcaatagcaagtgttgctcttgcagttgccactggtggtgcaactgcaccaggggcagtggcagcagccagaggggctgtcactgcagcagggaggttggcacaagggctccaaaaggttgtggacatcctacaaggcttgcaagcggtcatggaggttgtggtagccataagagacatcgtagagtcattgaaaaacatgggtcaactggtagaagcgcccgagatgccagagatgccaacagatgcagactggttaatttttgtaaatgaggtggaggcagtggcagagcaagtgccaacagaagtggcagaagttccagtgtggaaggctaagtgcaagaatgtggccgtgctagggcaagcgatgtgcaccacagcagcgtatatgagtgagctacagtatcagataacggtggaagagatgctacaagagattgcacaacgccaagcagacaggttagtggggatatcagcagcagatctatcaagctacacagagatggcatcacaaatagacatgcgtacaacccgaatcctccttgagctcatcaagatgttgtacattcaaaatgcagcaattaagtacgaatatttgtatgatgccaatgagaagcttaattcatggccagtgagcatggagactgtatggactatgctcttgcgacaagagaatgcagctctcttgggcttgctaaacttggggccctccaatgatttcacagtaacctatgctgttaaagacatacctgtcaagctgttagtggatggttatgattggaattttgagatcgcggtggaggatttttcaatctttccttcaggatggtctcgtgttcgcatacgatatgtcgagcttaaatttgaccaacaaggtactgatagcagtaacattgtcatccaccagccaagcactaacactggcttagtgtacatgctcttacaaggctctcgtttcctccatgaccgcaaacgtgaggaggtgatggactatgaggcaagcatgggagctgtatttgcatatgcctatgacctcaacactggtgcaaccactctctccaacatcccctcacagcaacatgccaacacatttatgcaaatgacacccttcaatgctgcttggagacttcgcctctctgcctctgctatggaaaatcagggattggtgtttcctacagccacttctcctgacaatactacccaaatttccatcacattctatgtcactgctattcgacgcatagaccatcgacaagagggtgatgaggagtaa

SEQ ID NO: 68 - DNA, 2433 bp, Bolbitis cladorrhizans
atggccggcatcgattacagcgtgctgtaccaggatgtgaatcagatcagcatccggctagagaagatggacttctctgaggtaatggcagtccatcgtatgtttgtccggatggatgatcttgatgtgagctccggtaccggactgttggcgggggcagaaaaggtgaagcgcctgtatgtgttcgcggatgtggtggagctgccatccaaaagagtgcggcttccgggcactgacatgatcatcatactgtgccgcatctttgttgtaaatggccgccacagcacagagttgtttctgccttccatgaacttgaacatggtcgcagctggcactgggagcattaggggagcgtacctgagcactacagcgttttcattgtcatccaacgctttgcagttcaagctgcaaagtggctcgatgacatcggccatacagctcaaagatgtggatttggctgccacactcacctgtgacgttcaggctgcatcggcatccatgcccatagttgtgaagacgactggcacatcacctgggaacattttggttcttggcatgagcacagccgtcgtcattcctgagagtgcggtggctgtcatcactgatgccaacattctgttgggcatgcaggtcactgtgctcattgccgagcttgtcaagactgctcacaattcagacgttgtcatagctgctgtcacgcggcatgtggaatggttgaaccacctcttggttcaggcacatgcagctgcacccagtgacgatgttgttgcactcttatatcgtactcaaggtttcattaaactgcaaagagaagacttagttgttccggggttgcagtatcgcatgtacaaagatctcatcaatcgaatggtgcaagtagctcagagctatgaccaagacttcaagcaattaaaactgtatgtggaacaaaataagatacttgggagctatttgttggagcaaaacaaggcatttgctgagaaggagaaggacatggatgcctttcactcgcaagtcattgcgctaaggaccaccgagcttaataacacaattgaaaggatggacgatttaagcaaacaaatggaggaacagaatgcagcaatggagcaagccaaagcggacatggatgcagggttgatagagtaccaaaacaaacaagttgcaaatgccgtctttgctgttttgggtgccattgctagtattggtctggcatttgcgactggcggagcaactgctcctggagctgtggctgcagcaggaacagctgtgaccgcagcggggaaggcagctgagggattgaagaaagtagtagagattcttgaaggcttacaagcagtgatggaggttgtggctgccataaaagagctagtgcaatcactgcaggagatagggcagctagtaaatgctcctgagatgccagatctgccttcaaatgcggaatgggatatttttgtgaatgaagtggaggcagtggcagagcagatgccaacagaggtgacagaggtgcctgcctggaaggccaagtgcaagaatgtggcagcgctgggccgagagatgagcaccatggcggcccacatttcggagctgcagtttgagataaaggtgcaagaaatgttgcgtgagatcgcacaaaagcaggcagataggttgtcgtccatcaagccagcggacttgacaaactacctcgagatggtgtccgaaatggacatgcgaacaacgcgcatgttgttggagctgattaaagtgctgtacatccagaatgcagcattgcaatacgagtatctacagacgccagcacgattgaacgcatggccagtgacgatgcaaacggtgtggacattgcttgtacaacaagagacaacggcgattactgggttgctgcagctgggggcgccttccgactacacgcagggatatgtagtggagaatatccctgtgagcttgttgctagaggggcgagactgggagtttgagctgccagtgatgaatgctgattttccgaccacatggtgtcgagtgcgcatccaccatgtggaaatgcaatttgatgccggagccaaacacctaccaagcacgagcacgggacaggtgtacatgctgctgcaaagttctcgcttcttcgctgatcgtgccaagcgagcaaatgagtatatcaactaccaggcaggcacgggcctctactaccagtacgcctaccgccttgccacgggcgaggccaccgtcaccaacatacccagcgaagagtatgccaacactttcatgcgcctggctcccttcactcgttggcgccttcgcctttctgcctctgctgacgaaaacaaaggccttgcatttcctactgccacttccgccgacgccaccacccaaatcaaaatcaccttccatgtctcggccattcggcgtatcagcaccttcgttgcggatcccaaataa

SEQ ID NO: 69 - DNA, 2556 bp, Bolbitis cladorrhizans
atggcctccctcccggactactatgagatctacaagaacgtgaatcaagtgtctcggccagtggccagcaggcaggcctcggaggtaacgagtatccaccgaatgtatttcaagttgaacctgttggaggtggcgctgctcaccaaagcggatgaagtgaaggagctggtagtgtttgcagacgtggtcgaaatggaaggaggcaaggtagagcttccagcatcacgtatagtcacaattgtgtgccgcattctttctttgaagcgggaggacgtggagttgggattcaagtttctggggcccgtcgaatgcgaggaagggtggcaagttgggctcaattcagagatggcctatataaggaggaccagccctcaggttcgactgtccatctacgcgcaagaagttgtgcacaatagtactggggcaatattgcgggtgacacatccagtgactgtaaggcaaagagtctctccacataggccatcacaatataccccgggcaccatgaaatggcagatcaacatctcttcggctcatgccgacctctccactgcccaacgctcgcacgagctccgaacacaacgtttttggagtgagccggaaaggacctggttgattaacccgcaggaatggtctcccttcacatttttccttcctccgggcttacttcctctggcaatcttaggggactccaatattatgctaggcatgcaatccaccttgctcatcgcagagctagtcctcagctaccaaacacatgcgcaagccacggtttctgctgcacaccggcatctccaatggcttaccacaaacttggtccaggtgctggatgatgactccctggagaacgagatcagagagcagcttctcgcacttctggcacgggcagaattggcctcaaaacttccacttgatggaagccaaaatttgattgttccccgcctcgaatatggccaatatcgtggtctcattagcagtatggctgccgtggccgaggcttataactctgaattcacggcggtgaatcttttcatacagcagaatgagattcttggcagctacctattacagcagaacaaggcatttgctgcacgggagaaggacatggaggctttccatgggctagttgtggaacgaaaacggcaggagttgagttctgctcaggagacgatggaagaactgaatgtccaactgacccaacagacagaggcgatggatcaagcaaaagaggacatggaagcaggtttgaagaaatacagggatgcacaagctgcaagagcattctttgcggttatgaaaggggtgctagaaattggggcagctatcttcactggtggagcaactatggggttggcagtacaaggggggatcaatgctgtaaaggcagtgagcagccttgcaggaaagctggatatggtactacagattatggagggaatggagaaggtaatggaggtcttgaatgcgatagatgacctcgtcgctgcagtttctgaaatcaataagatggtggaggcgcccgagatgccaagcatgccatccacacacgaatgggatatctttgagaacgagattgaggaggtggcagaaagcatgccagaggaagtgacagaggcacggacatggaggaccaaatgccggaatgtggcggccgtctgcagggcaatcagcaccaccgcatcctacattggccagctgcagtacgaacttttcgttcacagcaatcaggagttgattgcacgaaggcaggcagaacggctggaggcgattcagcctgcggatcttacaaactctctggagatggccacacagctggatatgcgaaccagccgcatgttgttaaacttactgaaggtgttgacgctacaaagtggggcgttgcaattccacttcctgctgccacccactccgttcacaggttgggtcaacatgggcatggtgaggaatgccttggtgaaacatgaagctgatgcggtggcagctcaggagagattgggcccttctacagactatgtgcggacgtatgtgatgagcggcattcctgtctcactcctgttggatggcgatgactggatcttcaccatcaacccacttgatggctccacgtttcctctgagctggtctcgagtgcgaatccggtacttggagatgaagttcactggaggggaggagttccacaagccaaccaccgatagtgggaaggtctacatgttgctccaagcttcgcgaaacttccaggaccggcttcgcagggaggtgctgcactatgaggctgcagtgccattgcaatatcagtacgcgtatcacctgacgactggtgaaacaactgttgaaaatcggccatcacagcagcatcatggtgagtacatgcagatgacacccttcggccaatggaggctgcgtctgtctgcctcagctttcgagaaccgaaaccttgccttcccgacagctgctaatacagatttggacgccgccaccacacaaatctccatcaccttcttcgttacggctgtccgagcagttgattttaggagccttgatgatcaagatatgtag

SEQ ID NO: 70 - DNA, 2700 bp, Blechnum brasiliense 'Crispum'
atgcagggtagattagcgagtatggcaggtagtgcaggagctgcagacgcctggagggaggtgtatcgagatctgaaccaggtaagcgacaggataaggttagatcagctggagttctcagaggtgatggtgatccaccgcatgcacatcaagatgtcggagctggatttggggcatctggagggcgcggagaaggtggagcgattgtatgtgtttgcggatgtggtagagttggatgtcgtaccgcacgagtcctcgtctgatggggacgtggtggtcagactgcccgggtccaagtccgttacgtttgtgtgccgtgtgtggcacatcaactatgctcttgtgcaaattagtagtttcgcgcgcatttccaggagcgtggtgctagagctccggcacatgaggtggcatttcaatgccatcactggtagaatgcacctcctagacccacaaactttgcaagacggtatggatctttgcttctgtgtgcatgcagaggttgtacagattgcctattaccctgatgtaacattcccagagtcgaacgactcgccatcttttcttcgatttttacgacttgagattgtgccggatcagctccgtgtcaccacccaaactgacggtccagtatgggcgcttcggggcgctttagaatattttatggcaccagacaatgatggccttctgaatgaggtatcatcgcagccagcaggcaccagtttcgtgctcaatatattgccggacaacctggacgttcagctgtttgcaaatctacgacctaattctggtacaaccctaacccgggacccaaacaccattgtccctgcattctctgtttacaaagagaaggaaggcgaacttctctccgatcccaacattttgcctgctatgcagaccagcatgcttatcggggagcttgtggaggttggtcagcctccatcagtaacaactgaagttgtgcgcaagcatgtagaatggctcaacaatctcttgcttcaggtgattgaagccaagcgaggcgagcatgtggaggactacgttgaactatcctttcgtgcgcagtatgtgataaagaaagtgggaaggatacagcggctggtagtgccacagttgcagtacagcgcatacagcaatctcatcaatcggttggctcaggtggctgaaagctatgaccaggcactcaggcagttcaggcttttcatacagcagaataagatcctcggtggatttcttttggagcaaaaccgggccttcgctgagaaggagcaggacatggacgttttctactccgagctcatcgctcaaaggcaaattgaactggacaacactcttcaaaagatgaaacatctgggcgcacagatggagactcagacagcagacatggagcaggcacaagcagacatggaggcaggcatccgggagtttcaaaatcgacaagttgccaggggcctcttcgctgtgctcggtgctatagcagcggttggtctcaccttgctcacaggtggggcagctgctcccctggccatgtctgcagccaggagcgctgtatcgctagcaggagcggtggcgcaagggcttcaaagagttctagacatcttggagggcttgcaagtggtaatggaggtcgtggaactcatcaatgatttgatctcttccctgcaagaactaggtcagcctgtggagctgccagaaatggcagagatgccaacggaggcagactggctcatttttgtgaatgaggtggagggcgtggcggagcaaatgccaacagaagtgtcggaagtagttgcatggaaaaccaaatgcaagaatgtagcggttctggggcgggagatgacaactctagcagcctacatttcgcagttacagtacgacatcaatatgcagcacatgctgcagcagattgccagaaagcaggctgatcggttgtcagccatcgagctgccagaccttagaaactatggagagctggtgacacagatggacatgcggaccacgcgcttgctggtggcactcatcaaggtggtgaacatccagaatgcagcccttatgtaccagtatctctcggagcccacgcctgtgtatgcatggccagtgaacatggacagcgtgtggcgcatgctcgtgcagcatgaacagtttgcgattcagggcttgatgaggttgggccctgcctttgatattgttcgcacatatgaagtaaagggcattcctgtgagcttgctcttggatggggatgattatgaatttgaaattccggcacaggaccatgtaacgtttccattatccttgtcgcgtgtgcgcatccatcaccttgagatgaagtttgtgcagggagagggtgaccagctccacatgcccgtcacagacacaggctctgtctacatccttctgcagggatcacgcaatttccatgatcgcagtgagggcacgatccttcattacgaagcggcaacatcgctggactaccacttcgcctaccgccttgacacaggtgagaccactgtcaccaacctgccctctgccgagttcctgagaaccttcatgcgcatgacacccttcactaactggaggctccgtgtgtctgcctctgcggaagagaacaaagggttggccttccccacggccacatccgctgatgccaccactcatattgccatcactttcttcatctctgcaatcaggcagattgccctctag

SEQ ID NO: 71 - protein, 809 aa, Asplenium australasicum
MAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAV

SEQ ID NO: 72 - protein, 861 aa, Asplenium australasicum
MGGAVPDYSHLYRELNQVSEGMKLDQMEFSEVMVIHRMFIRLHDLNIAHREGAEQVKRLYVFADVVELSGTSLTTLLPGTMMVVILCRVLSVRSFQSQHGLDFPHMRLHAVPGDNQMLRIHRRNPDSAQYDDYPVVCVHADVLEFPVTGGRDIFHLGPLANPCMVITFPPQSLEEAPVSSFTGSVRLWTAAASSPHRIDPNNLTFTPGFMVQQGGSFNLPFNTQSEDFWLLRRNLPDALLKDSSILLCMQTSMLIAELVEFSHPSSDVRAAVTLHAEWLNNLLLQASAKSQGTPHHDDYRALLFRAQYVVKGIGRSRGAVVPQLQYDMYSNLINQMARAADSYDQSLKQLKLFIAQNEILGEYLLEQNRVFAAKERDMEVFHSELIAQKTTELQTVMVKIDNLSLQMEAQVEDMEQAREDMEAGLRRFRNRQVANAMFSVFRAIGAVALTVLTGGAAAPLAISAAKGAVSIAGQAARGLERVLRILDDLQAAMELLKIIKDLVESLQEIGQLVDAPDMPEMPTEADWAIFVNEIEGVAEQMPEEVSEVSAWKTSCKNVAAVGRELMTTTAYMSQLQYDIQVQAMLQGIASKQADRLSSIQAADLSSFTEMVTEMDMRTTRLLVELIKVLHMQSVALMYQSLTLPELMNAWPVTMETVWRMLIQHEHAAVLGLIRLGPSFDFRKTLTVKDIPVDLLLHGEDWEFEISVDDFTVFPRTWSRVRIHHLEMKFVGSGDEAAPGGGMQGAHQPATKTGEVYILLQSSRVFHDRNKTKPLHYEAGIPLDYHYAYNLETGETTLSNLPSHDFIRAFMRMTPFATWRLRVSASAQENEGLAFPTATVGAGDTTQIAITFHVSAIREIAL

SEQ ID NO: 73 - protein, 905 aa, Asplenium nidus
RERGVLNGMLTSDHPFWGDWGVCSEAHRSICLVCPDQSLHEIAMGGAVPDYSHMYRELNQVSERMRLDHMEFSEVMVIHRMFIRLPDLDIALQEGAQQVKRLYVFADVVELPEMSTSVTVSETVTLRLPGTVIVVILCRVLFYQGFARYDLDFPHMRLHAVQPSGAGVLRMHRLNPDSVQYDDYPVVCVLADVVEFTRQRPSRLFRIGPLAYPSMIFTDERPPASSIVEPRPVSSFYCTIEFRWSSSNNIGPNSVGIGCVFRLSGGSTFSTGSPREDFWLFRRDLPDALFKDSSILPCMQTSMLVAELVEFCHPSPDVRAAIRSHAKWLNTLLLQASVASEGTPHHSDYNALLFRAQYVIKGVGKSRGAVVPQLQYDMYSNLVNQVARAADSYDQSLKQLQLFIAQNEILGEYLLEQNRVFAAKERDMEVFHSELISQKETELRTVVAKIDLLSLQMETQVADMEQAREDMEAGLRRFRNRQVANAIFSVFRAIAAVALTVVTGGAAAPLAMSTAKGAVSAAGQAARGLERVLQILDDLQAAMELLKIIKDLLESLQAVGQLVDAPDMPEMPTEADWAIFVNEIEGVAEQMPEEVSEVSAWKTSSKNVAAVGRELMTTTAYMSQLQYDIQVQAMLQDIASKQADRLSSTQAADLSSFTEMVTQMDMRTIRLQVELIKVLDVQNVALMYQSLVKPELMNAWPVTMDMVWRLLIQHEHAAVLGLMRLGPSFDFRKTLTVKDIPVDLLLHGEDWEFEIPVDDFRVFPATWSRVRIHHLEMKFAAAPAGTQGAHQPATKSGEIYILLQSSRVFHDRNKAEPLHYEAGVPLDYHYAYNLETGETTLSNLPSYDFIRAFMRMTPFTTWRLRVSASAQENEGLAFPTATVGTGDTTQIAITFHVSAIREIAL

SEQ ID NO: 74 - protein, 866 aa, Asplenium x kenzoi
MGGAVPDYSHMYRELNQVSERMRLDHIEFSEVMVIHRMFIRLPDLDIALQEGAQQVKRLYVFADVVELPETSTSASAEPVTLRLPGTVMVVILCRVLLFQGSYSAYDLDFPHMRLHAVPGEAQILRIHRRNPDSAQYDDYPVVCVHADVLEFPVTGGRDIFHLGPLANPCMVVTHPQLSLVEAPVSSFTGSVRLWSAATSSPHSIDPNNLTFTPSFSVQGGGSFNLSFATRSEDFWLLQRNLPDALLKDSSILLCMQTSMLIAELVEFSHPSSDVRAAVTLHAKWLNTLLLQASAKSEGTPHHADYRALLFRAQYVVKGVGKSRGAVVPQLQYDMYSNLVNQVARAADSYDQSLKQLQLFITQNEILGDYLLEQNRVFAAKERDMEVFHSELIAQKKTELLTVMAKIDLLSLQMETQAADMEQAREDMEAGLRRFRNRQVANAMFAVFRAIGAVALTVLTGGAAAPLAISTAKGAVSIAGQAARGLQRVLQILDDLQAAMELLKIIKDLVESLQEVGQLVDAPDMPEMPTEADWAIFVNEIEGVAEQMPEEVSEVSAWKTSCKNVAAVGRELMTTTAYMSQLQYDIQVQAMLQDIASKQADRLSSIQAADLSSFTEMVTQMDMRTTRLLVELIKVLNMQNVALMYQSLTMPEPMNGWPVTMETVWRMLIQHEHAAVLGLMRLGPSFDFRKTLTVKDIPVDLLLHGEDWEFEISVDDFTAFPATWSRVRIHHLEMKFVGSEEAAPWGMQGPHQPATKSGEIYILLQSSRVFHDRNKTKPLHYEAGIPLDYHYAYNLGTGETTLSNLPSYDFVRAFMRMTPFTAWRLRVSASAQENEGLAFPTATVGAGHTTQIAITFHVSAIREIAF

SEQ ID NO: 75 - protein, 903 aa, Asplenium x kenzoi
MAARSAGAADGWREVYRGLNQVSDRIRFDQLEFSEVMVIHRMHIKMSELDLGHLAGAEKVERLHVFADVVECDVPPHENSSDPDLVIRLPGSVSVTFMCRVWHVNYGIVQRTSTVRVARTVVVQLPHMRLHFNATTGSMHRLHPQTSQDGSDTCFCVYAEVVQIAYYPDVTYPESNDSPVGLRFLRLEFGSDQLRVTRQSEGPVWALRGSLNYSMSPDNDGLMNEVSSQPAGTSFILNILPDNLNLQLMASLRRNSNSTLTRDPDNIVPAFSVYREKLAVELLTDPNTLPPMQTSMLIGELVEVGQPPEATIEVVRKHIEWLNNLLLKVIEAKQGEPVEDYIELSFRAQYVIKKVGRVQRLVVPQLQYSAYSNLINRLAQVAENYDQALRQFRLFIQQNKILGGFLLEQNRAFAEREQDMDVFYSELITQRKIELDNTLQTMKHLGAQMETQTAGMEQAQADMEAAGIRRFQNAQVARGLFAVLGAIAAVGLTLLTGGAAAPLAVSAARRVVTVAGAVAQGLQRVIDILEGLQVVMEVVELINDLISSLQDLGQPVDLPEMAELPTQADWLIFVNEVEGVAEQMPTEVSEVVAWKTKCKNVAVLGREMTTLAAYISQLQYDIQMQHMLQQIARKQVDRLSAIQLPDLKNYAELVTQMDMRTTRLLVALIKVVNIQNAALMYQYLSEPTPVYAWPVSMDSVWRMLVQHEQFAVQGLMRLGPAFDIVRAYVVKSIPVSLLLEGDDYEFELPVEDHITFPLSLSRVRIHHLEMKFVQGAAGGSDQGTQIVHMPITDTGSIYILLQGSRNFHDRNESAILHYEAATSLDYHFAYRLDTGASTVTNLPSAEFLTTFMRMTPFTNWRVRVSASAEENKGLAFPTATSADAATTHIAITFFISAIRQVAL

SEQ ID NO: 76 - protein, 892 aa, Asplenium x kenzoi
MHPTGHDGISIPLEQGDDDYAEESRQMIRPRFKANGLELDYERIYAGSNSIAREVGLNKVICGEVMAIHRMFFRLDTLSQELLRQPELVKRLVVVADVVEIEGANATLSLPGSSLVLIFCRILILKSRDVVLDLSNWDLRVATTTPLHRCSIRAQRVVVASGSLSASLLIQVKHKFEWSDGTHLDQYFRRPISFTASRINSSAAITTRTTSATRSINTWPGTAPVSNFIQVNSEKFNVLVNAVPWKGVVDCQAALPSLDDLLHPDVISGIQSTLLIVETILNFQTDNPDIIVLARQHAEWIVDSLLQVVPLPNSTLGVPEVKTLLARAQMLIKLPTDGSQHLRVPLLAYGEYQEDIERLLRNAEAYDQEYRALTRFVQLVEIIGSEFLQLSKTLAQRERDIETFESLVVIRKQSELDQAIRRMNSLMTEIERRSFEMADAKARMEEGLQDYNRRQLTRAIFGILGALLQLCASLKFGGGADIAGGIATTVPAAIDLIHAVQDDSASTKLLAISQTLMDLEKIVDVVNAVNELVESATELEDIIHAPELPIILPYTWDILENDIEEFAALMPSEVSEVVTWKAKCRNLVAVCREICIAASFACEVQYELFVHARQQEMARRQAERLEGMQTAADLSSFIELATQADMRTTRLLLSLLNVLAGHQGALHYHYLMELEVFTSSWPSVDGVRMHLLQLNQRARARENALFGDGVLTVDLQHDYVLDAIPVSLLLSGEDWSFTINPERNASAFPTPWDYVRIRYVEMKFTGEHLPVTDTGEIYLLLRSSANFQDRLEEQVFEYEAAVPLVYQYAYNLSTGETTLPNLPSESGKFFRMTPFTRWRLRLSASAYQNEGVSFPTIPGDPTSADTPVRITITFYVTALPQIQSRSLLDMST

SEQ ID NO: 77 - protein, 807 aa, Polypodium musifolium
MADLDYSKLYQDLNQISVRLEKTEFSEVMVVHRMFVRMDDLDVSSGSGLLSGAEKVKRLYVFADVVELPSKQVRLAGTDMIVVFCRIFVPEGRHYAELFLPSMNMSMVGADGEGSIRGVILSPTVLTTLSNALQFRLECGSMTSVMRLNDVSAGATLTCNVQAASACVPLKVKTTGTSPGNICVLGLSTAAVVPESVVAVITDANILLGMQVTVLIAELVKIAHNSDGVIAAVTRHVEWLNHLLVQAQAAAPSEDVVALLYRTQAFIKLRKEGLIVPRLQYHMYKDLIDRMVQVAQSYDQDFKQMKLYVEQNKILGSYLLEQNKAFAEKEKDMDASHSQVIALRTSELQSTIERMDDLSKQMEVQSTAMEKAKADMDAGLIVYQNKQVADAVFAVMEAIASIGLAFATGGATAPGAVASAGAAVSAAGKAGEGLKKVVEILEGLQAIMEVIAAIKGLVQSLQKIGQLVNAPEMPDLPSEAEWEMFVKEVEAVAAQMPTEVTQVPAWTAKCKNVAALGREMSTTAAHIAELQYEIQVQGMLQQIAKKQADRLSSIKPADLTNYFEMVSEMDMRTTRMLLELIQVLNIQNGALRYEYLQPAAPLNAWPVTMQTVWGLLVQQEAAAINGLLQLGAPSDFTREYVVGDIPVKLLLGGGDWEFELPVTDADFPLTWCRVRIQHVDMQFDAAAEHLPTTSTGEVYMLLQSSRFFEDRAQHEDEFISYEAGTGLQYQYAYRLATGEATVTNVPSEAYVNTFMLLAPFTRWRLRLSSSAPENKGLAFPTATSADATTRIKITFHVSAIRRISLAR

SEQ ID NO: 78 - protein, 806 aa, Polypodium punctatum 'Serratum'
MADVDYSKLYHDLNQISIRLGNVEFSEVMVVHRMFVRLDDLDVSSGSGLLSGAEKVKRLYVFADVVELPSKQVRLAGTDMIVVFCRIFVINGHHGTELFLPSTSMSMVAAGEGSIRGVILSPTTLTPLSHALQFKLESGSMTSVMRLNDVSVAATLACNVQAASASMPLKVKTTGTSPGNICVLGMSTDAVVPENVKAVMVDVNILMGMKLTVLIAELVKIANNSDAVIAAVTRHVEWLNYLLVQALVAAPSDDVVMLLYRTQALIKLQKEGLIVPRLQYHKYKDLIDRMVQVAQSYDHDFKQLKLYVEQNKILGSYLLDQNKAFAEKEKDMDASHSQLIALRTSELESTIERMSDLSKQMEVQSKAMKQAKADMDAGLVEYQDKQVADAVFAVLEAVASIGLAVATGGASAPEAVASAGAAVSAAGKAAEGLKKVVEVLEGLKAVMEVIAAINKLVQSIQKIGQLVSAPEMPDLPSDAKWEIFVNEVEAVAAQMPKEVSQVPAWTAKCKNVAALGREMSTTAVHISELQYEIQVQGMLQEIAKKQAERLSSIKPADLTNYLEMVSEMDMRTTRMLVELIRVLNIQNGALRYEYLQPAAPLNAWPVTMQTVWGLLVQQETAAINGLLQLGAPSDYTREYVVRDIPVRLLLGGGDWEFELPVTDDDFPLTWCRVRIHYVDMQFDAAAEHLPTTSTGEVYMLLQSSRFFDDRAKHEDEFVSYEAGTGLQYQYAYRLDTGEATVTNVPSDAYVNTFMLLAPFTRWRLRLSTSAPENKDLAFPTATSDDATTHIKITFHVSAIRRISLSR

SEQ ID NO: 79 - protein, 854 aa, Polypodium punctatum 'Serratum'
MERAVPDYSHMYRELNQVSERIRMDQMEFSEVMVIHRMFIRLPDLSIAHLDGADKVKRLYVFADVVELGSVQQTSSLPGSIMVVIMCRVLTLHVDPIATAYQCDFPHMRLHAFFGSNGVRIDRRNSDSVHDDYPVITVSANVIEFSGTRAETLFAIAPLRDPSMIISSDLISNTVERPASGFFCNVVPNWGQPSPITVDPLRIRFQTGATMVGGGSLTFPLGPEGFSILQRNLPDLLLIDPNILLCMQTSMLVAELVEFSHPSSDIHAAVTDHVAWLNTHLLQASAKAQGTSSHDDYLALIFRAQYLLKGMGRARSLVVPQLQYDVYRNLISQMARVAESYDQSLKQLQLFVAQNKILGGYLLEQNRAFAAKERDMEVFHSELIAQKELELKNTMVKMEQLSLQMETQIADMDQAKEDMDAGLRRFQNRQVANAMFAVFRAIGAIALTVVTAGAAAPAAMAAAKGAVTTAGQAARGLVRVLEILDDLQAAMEVFKLIKDLVESLREVGQLVDAPDMPDMPTEADWSIFVNEIEGVAEQMPEEVSEVSAWKTSCKNVAAVGRELMTTSAYISQLQYDIKVQALLQDIANRQADRLSSIQAADLTSYTEMVTQMDMRTTRLLMELIKVLDMQNVALMYQFLTPPTPMNAWPVTMETVWGMLVQHEHAAVLGLMRLGPAFDFKRTFIVKEIPVDLLLHGEDWQFEIPVNERTVFPSTWSQVRIHHLEMKFVGSNNIDHEGSHQPITESGEVYILLQGSRVFHDRNKSELLHYEAAVPLDYHYAYHLETGETTLSNSPSNEFIRTFMRMTPFTTWRLRVSASAQENQGLAFPTTTVGAGDTTQIAVTFSVSAIREISL

SEQ ID NO: 80 - protein, 896 aa, Polypodium punctatum 'Serratum'
MHPTGHDGISNIPLEQCHDDYAEERQMKPRFETNGLELDYEKIYAGSNSIAREVGLDKVNCGEVMAIHQMFFRLDTLSQELLRRPELVKRLIVVADVVEIEGSNATLSLPGSSLVLIFCRILILKSRNLVLDLDNWNLRAASTTPLHRCSIRAQRVVIASGFSLYSSLLIQVKHKFEWSDGTHLDQYFGRPFYFTAIGINSSATITTTATSAMRSINTWPGTAPVSNFIRVNSEKFNVLVNAVPWKGVIDCQAALPSLDDLLHPDVISGFQSTLLIVETILNFQTDNPAIISLARQHAEWILDSLLQVVPLPDSTLGVPEAKTLLARAQILMKLPTDGSQHLRVPLLAYGEYQEDIERLLRNAEAYDQEYRELTRFVQLVEIIGSEFLQLSRSLAQRERDIEAFESLAVIRKQSELDQAIRRMNSLMPEIERRSFEMADAKARMEEGLEDYNRRQLTRAIFGILGALLQLCASLKFGGGADIAGGIATTVPAAIDLIHAVQDTSASTKLLAISQTLMDLEKIVDVVNAVNTLAESATELEDIVHAPELPLIPPYTWDILENDIEEFAALMPLEVSEVVTWKAKCRNLVAVCREICIAASFACEVQYELFVHARQQEMARRQAERLEGMQTAADLSSYIELATQADMRTARLLLSLLNVLAGHQGALHYHYLMELEVFTSSWPTVDSVRTHLLQLNQRARARENALFGDGVLTVDLQHDYVLDAIPVSLLLSGEDWNFTINPERNASSFPTPWDYVRIRYVEMRFTGEHLPVSETGEIYLLLRSSANFQDRLEEQVLEYEAAVPLVYQYAYNLSTGATTLPNQPSESGKFFRMTPFTRWRLRLSASAYQNQGVSFPTLPGDPNSDSPVQITITFFVTALPQIQSRSLDMSDGDPTEE

SEQ ID NO: 81 - protein, 907 aa, Polypodium punctatum 'Serratum'
MASITSGAGADWRELYSEMNQVSERLRLDQLEFSEVMIIHRMHIKLSELDLGHLEGADKVKHLYVFADVVELDNAADPSTPVDVRLPGSISVVFLCRVWHVSRRLTVGVNSPQYWLPTFDGRPVRIQLPHVKWHMNTLTRSMHRIDPETLQDLSGPLLCVYADLLRTSLHPPVGHSNWDAALAFPSMTVLREVEVLPCFDHSTPRQGLLTLTSNAAPQWVNQLRAAFIFTDQDAMTEILSLPADASVILNKNRPSIILTAGQSGGYTDRNVSAPAFSVLREGAETPIDSLTDPNFLPAMQTSMLIAELVEVGRPSAAIIEVMHKHVEWLNNLLLQVIEAKKGKDDVEDYIQLSYRSQYILKNVGRIDRFVVPQLQYDTYSPLINRMAQVAESYDQALRQFRLFIQQTQQNKILGAFLLDQNRAFADKEKDMDIFYSELIAQRQIELHNTLQKMEQLSLQMETQSADMEQAQADMEAGLRRFQNERVARAVFGVLGAIAAVALAFVTGGATAGAAIGAAKTAVTLAGAAARGLQQVLEILDGLQAVMEVVGMIKELFESLQELGQAVDLPEMPEMPLESDWHIFVNEVEAVAEQMPTEVSEVVAWKTKCKNVAVLGREMITLATYISQLQYDIQMQDMLQQIARKQADRLSAIQLSIPNTGYTEMLMQMDMRTTRLLVALIRAVHIQNAALMYQYLSEPIPVSAWPVNMDAVWRILVQHEQSAIQGLLRLGPAFDIERVFVVEDIPVSLLLEGDDYEFDIPVEDNITFPLSLSRVRIHHLEMKFVASGGQKQVHMPVTDSGSVYILLQSSRNFHDRNERAVVHYEAATSLDYHYAYNLETGQIKVTNQPSAEFRKTFMRSTPFTNWRLRLSASAEENKGLAFPTATSADATTQIVVTFHISAVRQVAF

SEQ ID NO: 82 - protein, 902 aa, Polypodium punctatum 'Serratum'
MANDTSSGIVDWRELYRDMNQASDRIRFNQLEFSEVMVIYRMHIKMSELDMGHLEGSEKVKRLYVFADVVEYDANGIARLPGSISVVFLCREWHVSYHLVARMDRNPPRYQLDLAQGVIISLPHMAWHLDVRRQSMHRLDPETLQEFLEPSFCVYADDISVAYYSLNGASWDPALQFPDTAELAKCALLIYSNSNPTPNHVLLTSNRFNGTRWAFRFEFSMYYIDNEDVAKDIALQPPGTRVIFKREGLHLVVLAMDSANRIISFDPERGDLDAYMPAFSLLRQDAKFPIELLTDPNILSAMQTSMLIGELVEVGNPSTAVTEVVHKHVKWLSKLLHQVIEEKNGKDVEDYIGLSFRAQYVIKKVGRIRGLVVPQLQYDVYSNLINRMAQVAESYDQALRQFRLFIQNNKILGGFLLEQNRAFAEKEKDMDVFYSELITQRQIELDNTLQKLKRLSLQMETQQADMEQAQADMEAGLRRFQNRQAARALFAVLGAIAAVGLAFLTGGATAPAALGAARTAVTVAGSVVSGLQRVLEVLEGLQAVMEIVVIIKDLFSALQDLTQAVDLPDMPEMPLQSDWLIFVNEVEAVAQGMPTEVSEVVAWKTKCKNVAVLGQEMTTTAAYISQLQYDIMMQDMLQQIARRQADRLSAIQLPDLTNFTEMVIQMDMRTTRILVALIKVMYIQNAALMYQYLSEPTPVSAWPVNMDTVWRMLVQHEQLAIQGLLRLGPAFDIVRTFVVKSIPVRLLLDGDDYQFEIPVEDPLTFPLSLSRVRIHHLEMKIVQGAHVHTPITATGKIYILLQGSRNFHDRNEGKIMHYEAATALDYQYAYQLDTGETTVTNLPSAEFLRTFTRMTPFTNWRLRLSASADENEGLAFPTATSADATTEIAITFHISAIRRISD

SEQ ID NO: 83 - protein, 886 aa, Polypodium punctatum 'Serratum'
MEYSSLYGDVNQVSLRFQNMEFSEVMVVHRMHVRLEELDMTGLEGIEKVKRLYVLADVVELPSTATQVFQYLRLPASISAIILCRVLYIPEVDQRPHMAQCSLDFPFMRLHVVGSAHENGGGVMQAFSSDATPSNIGIYFHADRFIYRQATSSASNFVLPLDVRVSFGSSTFSAPTLRPDWQNLNVSNIQYGPQHLSRGPPLTSSDSDLQRSDEIELLAQQDVWSPLLHVAFSPNAPPGNIPGTQGIFRPSSACSFFHVPPPDVPANVLTDPSIILGMQMNMLIAELVLAAHNSPQVMNVITKHVLWLNKILLQVASPNDDILALLFRIQAFMKMAKEPRFVVPRLQYHMYGSLINRMVQVAQNYDQEFKQLKLFIAQNKILGSYLLQQNRAFAEREREMSAFHSQVVSMRRSELQSAIQTMDNLSLQMESESEAMNEAQENMVEAIQEYERKLLARALFSVIGAIASVALAFATGGATAPGAVAAAGGAVAAAGRLAAGLQKVVDILQGLQAVMEVVVAIRDIVESLKNMGQLVEAPEMPEMPTDADWLIFVNEVEAVAEQVPTEVAEVPVWKAKCKNVAVLGQAMCTTAAYISELQYQITVEEMLQEIAQRQADRLVGISAADLSSYTEMASQIDMRTTRILLELIKMLYIQNAAIKYEYLYDANEKLNSWPVSMETVWTMLLQQENAALLGLLDLGPTNDFTVTYAVKDIPTKLLVDGFDWNFEIAVEDFAIFPSGLSRVRIRYVELKFDQQGADSSNIVIHQPSTNTGLVYMLLQGSRFVHDRKRQEVMDYEASTGPVYAYAYDLNTGATTLNNIPSQQQANTFMQMTPFNAWRLRLSASAAENQGLVFPTATSPDNTTQISITFYVTAIRRIDLRQEGDVE

SEQ ID NO: 84 - protein, 813 aa, Adiantum pedatum
MADIDYSVLYNDVNQISIRLERMDFSEVMAVHRMFVRMDDLDVSSGTGVLEGAQNVKRLYVFADVVELPSKQVRLPGSDMIVILCRIFVRNGRHNTELFLPSMNMSMVAAGNGTIRGVNLSTTMSSSSSNALQFNLRSGSMTSTVRLKDVDVAAALTCDVQAASASMPLTVMTTGTSPGNIWVLGMTTAVVIPESAVAVITDANILLGMQVTVLIAELVKTAHNSDVIIAAITRHVEWLNHLLVQAHAAAPNEDVITLLYRTQAFIKLKREGLVVPRLQYHMYKNLIDRMVQVAQNYDQDFRQLKLFVEQNKILGSYLLEQNKAFAEKEKDMDAFHSQIIALRTTELNNTIERMGELSKQMDQENEAMEQAKADMDAGLIEYQNRQVANALFAVLGAIASIGLAFATGGATAPGAVSAAGAAVTAAGKAAEGLKKVVEILEGLQVVMEVVAAIKELVQSLQQIGQLVDAPEMPDLPSNADWEIFVNEVEAVAEQMPTEVTQVAAWKAKCKNVAALGREMSTMAAHIAELQYQIQVQEMLREIAQKQADRLSSISPADLTNYLEMVSQMDMRTTRMLLELIRVLYIQNAALQYEYLQTPAPLNAWPVAMQTVWGLLIQQETTAITGLLQLGAPSDFTQEYVVKDIPVSLLLEGRDWEFELPVLNADFPSTWSRVRIHHVDMQFDAAATSIHIPTTNTGVVYLLLQSSRFFDDRARRANEFISYEAGTGLFYQYAYRLATGEATVTNIPTDEYANTFMRLTPFTRWRLRLSLSAEENAGLAFPTATSADDTTQIKITFHVSAIRRISTRSDGVSS

SEQ ID NO: 85 - protein, 882 aa, Adiantum pedatum
MAAAAREYSELYKDLNQISERIRLDQMEFSEVMVIHRMFIRLEELDLGHLEGAERVKRLYVFADVVEVEEGGNFIETGPLARLPGSIMVVILCRVLSVRVLMFDNGNNAMRLQLPHMKLRVVEITTQPTTKLQIHRADAEDYQYPALCIHADVIQASIRLSSSSNRPPMDLRFFNFRPNRGSDNVVFSSESRSLIDEPVEIFYVYSHIPRFIHALPIPEAATVDPASRSNDWYYVSLRRVNSTLSSSVAAEGELEPAFSLLKPKIPVVVLTDPNILLAMQTSLLIAELVEVAHPSAETADAVAKHVEWLNKILLQATKVEGILNSSHDEHLALLFRAQYLMKMRPGRTRNLVVPQLQYDVYSNLVNRMAQVAESYDQSLRQFKLFIDQNKILGSYLLQQNKAFADKERDMDVFHSELISQRKIELDNTILKMDQLSLQMESQREDMDQAKKDMDAGLREFQNRQVANAMFAVIGAIAAIGLAFITGGATAPAAVGAAKTAVTAAGAAARALERVVEILDSLQAVMEIVSIIKELVSSLQEIGQLVEAPDMPPMPTEADWFIFENEIEGVAEQMPTEVSEVSAWKTKCKNVAVLGREMITTATYISELQYDIKVQGMLQEIATSHANRLSSIQATDLSNYTEMVTQMDMRTTRMLVALINVVHMQNAALMYQCLSPPTYVNAWPVTMETVWSMLVQHEHAAVLGLMRLGPSFDFMRTYVVEGIPVQLLLDGEDWEFEISVEDYTTFPSTWSRVRIHHLEMKFVQAADVHQPITDTGKVYMLLQGSRIFRDRNRADAIRYEAAMSLDYHYAYRLDTGETTLSNLPSQDFTRTFMRMTPFTNWRLRLSASAEENKGLGFPTATSAGSTTQIAIIFYISAIRRISL

SEQ ID NO: 86 - protein, 888 aa, Adiantum pedatum
MEYSALYGDVNQVSLRFEKTEFSEVVVVHRMHVRLAELNVTLGDNNILLQGSDRVKRLYVLADVVELPPIFSTSMSLPGTVSVVILCRILYLPYLEDASSASGWAVHAALLRLRVVEMHAGFAQVFTIPANDSSAAAPADIGLYIHADRIIYRDDPGRSIPVIEVRVGGDSRFSPFLPGSPEIRLSSVQYVREFSKGQPVAPEDSELQRSDEIELIAPSGSEQQLRAAFGASVGMNLLFHFSSSFDILSLDPVPAALLTDPNIITGMQMNMLIAELVLTAAHNSPQLIKVVTRHVEWLNKMFLQLASPNDDILALLFRVQAYQKMAKQPHPVVPRMRYSRYEGLINQMVQIAQSYDQDLKQLKLFIAQNEILGSYLLEQNKAFAAKEKSMSEFHLQVSDLRRSELNDAIQKMTGLGEEMEVEKEAMDQAYKDMEQGLQEYEKRQIVTAVFAVISAISLCALGFVTGGATVAAVPGAVANAAQAVSAAVSLANKLQKVMGILEIINQVVQTAAAIKEVIELFDNMGQLLEAPEMPEMPSNYDWLIFVNEVEAMAEQLPVEVNERIVWKAKCKNVAVLGQEMCTTGSHIADLQYQIKVEEMLREIAQSQAERLEGISSADLSSYTEMVSQIDMRTTRLLFQLIKVLHIQNAALKYEYLYAADEHLVSWPVSMETVWTMLLQQQRLSLLGWENLVGTNNLPNDDTRTYVVKDIPVEVLLSGRDWPFVIHEEDYTAFPSGWYYVRINHVELKFEQQTAGSTDIVIHQPSTNTGRLYMLLQSSRFFHDRNQGVKMEYEGSRGLSYPYAYNLNTGETTHNNIPSDQFKNIFMQMTPFTTWRLRLSASAEENEGLVFHPPSTSPTSTTQVSITFHVTRIRRIDRFTSTVHQKHAS

SEQ ID NO: 87 - protein, 897 aa, Platycerium bifurcatum
MAAARSAGANEAWREVYHDLNQVSDRIRLDQLEFSEVMVVHRMHIKMSELDLGHLEGAEKVERLYVFADMVECDVPPHASSSDGDLVIRLPGSLSVIFICRVWHINVGVVQLTSTVQMSRTLIVQLPHMRWHVNATTGSMHRLHPQTSQEGPDTSFCVYAEVVQVAYYPDVTFSEFDGSPTLRFLRLEFESDQLRVTTQTEGPIWAIRASLDTTMTPDNDGLLNEISAQPAGTIFKLNILPDNLIVSLFGSLRPNSSTSLTRVPDNLLPAFSIFREKAVELLTDPDVLSAMQTSMLIGELVEVGQPPEATTEVVRKHIEWLNNLLLKVIEAKQGQHVEDYVELSFRAQYVIKNVGKIQRMVVPQLQYSAYSNLINRMAQVAESYDQALRQFKLFIQQNKILGGFLLEQNRAFAEKEQDMDVFYSELITQRQIELDNTLQKMKHLGTQMDTQTADMEQAQADMEAGVRKFQNEQVARGLFAVLGAIGAVGLTFLTGGAAAPLAISTARRAVSVAGAVAQGLQTVLDILEGLQAVMEIVHLINDLISALQELGQPVELPEMADMPTEADWLIFVNEVEGVAEQMPTEVSEVVAWKTKCKNVAVLGREMTTLAAYISQLQYDIEMQHMLQQIARKQADRLSAIQLPDLRNYAELVTQMDMRTTRLLVALIKVVNIQNAALMYQYLSEPTPVYAWPVNMDSVWRMLVQHEQFAIQGLMRLGPAFDIVRTYVVKSIPVSLLLDGDDYEFEIPVENHITFPLSLSRVRIHHLEMRFVQDGDTAQGAHVHMPITDTGSIYILLQGSRNFRDRNEGAILHYEAATPLDYHFAYRLDTGETTVTNLPSAEFLTTFMRMTPFTNWGLRVSASAEENKGLAFSTATSADATTQIAITFFISAIRQIAL

SEQ ID NO: 88 - protein, 895 aa, Platycerium bifurcatum
MHPRAHDGISIPLQQGDDHDAEERQISQMRPRFKANVVEDYEEIYRGSNSIAREVGVSKVNCGEVMAIHRMFFRLDTLSQELLRQPERVQRLIVVADVVEIEGSNDTLSLPGSSLVLVLCRILILKSKDVVLDLTSWDLTVATTTPLHRCSIHAQRVVVASGSLSASLLIQVKHKFEWSDGTHLDQYFGRPFSFIASEINSSATATTRTNSAMRSISTWPGTAPVSNFIRVNSEKFNVLVNAVPWKGVVDCQASLPSLDDLLHPDVISGIQSTLLIVETILNFQTDNPAIIILAQQHAEWIVDSLLQVVHLPDSTFGVAEVKTLLARAQMLMKLPTDGSQHLQVPLLAYGEYQEDIDQLLRNAEAYDQEYRELTRFVQQVEIIGNEFLQLSRSLAEKERQIEIFESLVVIRKQSELDQAIRRMNSLMTEIERRSYEMADARSEMEQGLEDYHRRQLTRAIFGILGALLQLCASLKFGGGADIAGGIATTVPAAIDMIHAVEDASANTKLLAISQSLMDLEKIVDVVNAVNALVESATELEDIIHAPELPLIPPYTWDIMENDIEEFAALMPSEVSEVVTWKAKCRNLVAVCREICIAASFACEVQYELFVHARQQEMARRQAERLEGMQIAADLSSYIELATQADMRTTRLLLSLLNVLAGHQGALHYHYLMELEVFTFSWPSVDSVRMHLLQLNQRARARESGLFGNGVLTVDLEHNYVLDAIPVSLLLSGEDYNFTINPERNASSFPTPWDYVRIRYVEVKFTGEHQPVTKTGEIYLVLRSSANFQDRLEEQVFEYEAAVPLVYQYAYNLSTGATTLPNLPSQSGKFFRMTPFTRWRLRLSASAYQNEGVSFPTLPDLPGAADSPVQITITFYVTALPQIQTSSTDQDPASTT

SEQ ID NO: 89 - protein, 906 aa, Nephrolepis falcate
EIETEKVLIVCERVAYLFLGGWGACSEAPYRAIGILSADQNPHEIFTMGGAVPDYSHLYRELNQVSERIRLDQMEFSEVMVIHRMFIRLPDLNIAHLEGAGQVKRLYIFADVVELGGHLVTTQLPGTVMVVILCRVLSLRSPTARYGLNFPHMRLHAVFQSASRILHMHRLIPDSAQYDAYPVVCVHADALEFSGTSTGGIFHIGPLRYPSMIVTSESHSAVDAQISSFSCNVSLRSASASSPLKINPDNVSFQSMFNLVTGGGFGFAVRPEEFWLLRRDLPDALLNDSSILLCMQTSMLVAELVEFSHPSSDLHAAIILHAEWLNTLLLQASAASQGTSHHDDYLALIFRAQYLIKGVGRARGAVVPQLQYDMYSNLINQMARAADTYDQSLKQFQLFVAQNKILGGYLLEQNRAFAAKERDMEVFHSELIAQKKTELQTVMVKIDKLSLQMDTQVADMEQAREDMEAGLRRFRDRQVANALFSVFRAIGAVALTVLTGGAAAPLAISAAKGAVSIAGQAARGLERVLQILDDLQAAMELLKIIKDLVESLQEVGQLVDAPEMPDMPTEVDWAIFVNEVEGVAEQMPEEVSEVSAWKTSCKNVAVVGRELTTTSAYMSQLQYDVQVQAMLQDIARKQADRLSSIQAVDLSSFTEMVTQMDMRTTRLLVELIKVLDMQNVALMYQSLIMPEPINAWPVTMETVWGLLIQHEHAAVLGLIRLGPSFDFRRTFTVKDIPVDLLLHGEDWEFEIPVDDFTVFPVTWSRVRIHHLEMKFVGTDEAAPAPGLQGTHQPTTKTGEIYILLQSSRVFHDRNNTKPLHYEAGVPLDYHYAYNLETGETTLSNLPSYDFIRAFMRMTPFTTWRLRVSASAQENEGLAFPTATAGNGDTTQIAVTFHVSAIREIAL

SEQ ID NO: 90 - protein, 872 aa, Nephrolepis falcate
MEYSDLYHDVNMLSLPLHRTELSEVMVVHRMHVKLRDLNLETAVSDKVHRLYVVADVVEVTLDTVSLPCKVSVVILCRVLHVEQSSVLFSSLLLPNMNVRVVLSNNRMQVYPMATDGSADDVALYIHADRVIRRQGAWTLVRVMHMSITGPESTFSVPHLPDPALFNRVMVNVQMDAGPSIPASESDLQRSDETELVSRVSNGVTVSASIAGSAWTMPADNPSATFTVFPNPPAQPVARGVLTNPYVIIGLQMNMLTAELVQAAHNAPLLIRAVTRHVEWLNKILVEALQVVSGNEDLLALLFRTETYLKMATESRSVVPRLQYHMYSDLIHRMVQVAQAYDDEFQRLRLFIAQNEILGSYLLEQNKALASREREMSAFHSQVVSLRRTELDNCLQRMDQLNVQMERENKAMEEAQEKMNEALEAHQRRGLARALFAVLGAIAAVALTVATGGAAAPAAVAAAGQAVTAAGTLAQGLKTVVEILEGLQALMDLVVIIRELVENLQTIGQLIDAPEMQEMPSNADWLIFVNEVEAVAAQMPEEVFGSVAVWKAKCRNVAVLGQEMCTMAAHIAELQQQIKLEELLQEIADRQADRLLGISAADLSSFTEMLTQIDMRTTRLLLQLIKLLHIQNVAINYEYLFPANGRLSSWPVTMHTVWEMLLQQESSAITGLLALGPSTDFARTFVVHDIPVGLLVDGFDWQFAIPVMDDSSAFPIGFSRVRIRHVELKFSAIDIDASATVHQPRTDNGFIYILLQSARSFSDRRVRQAMDYEASEGLAYPYAYNLTTGVPSLTNLPSQEHANTFMRMTPFTEWRLRLSSSAEENRGLTFPTATSPDDSTQISITFHITAIRAIDFRGMDDEERSKSDSSQK

SEQ ID NO: 91 - protein, 895 aa, Nephrolepis falcate
MEYSDLYADVNQVSLRFQQTEFSEVMVVHRMYVRLLDLDMTTEPHLQMLAGSEKVRRLYVVADVVELPATATNMRLPATASVVILCRVLYVQDVNSPYLACGLHFPLMPLRVVEDTQQGRVHVFPVVGGESASVDKIGLYIHADRVVYRQDTSTANPLQPLQLRVIGNGSTFSTEVRPDWPKTLEVSSLLMWLTLSKGQPIPAAESDLQRHDEVELLSPPSPDRLSVVFAYLAPGNLFSIAVDVEYIGAGFCYFRIPPADPVPTEVLTDPYVIIGLQMNMLIAELVLAAHNSPPVISVVTKHVEWLNKILPNDDILALLFRVQLSLPNDDILALLFRVQAFLKMAKQPRSVVPRLQYHMYSPLINRMVQVAQVYDQEFKQLKLFIVQNQILGSYLLEQNKAFASRETEMSSFHSQVVSLRRTELNNAIDRIDQLSVQMENENEAMDQAKEDMMQAIAEYEKKQLANALFAVLGAIASVALAFATAGATAPGAVAAAGAAVSAAGRLAEGLKKVVEILEGLAAVMEIVAAIRDLVESLQNLGQLVETPEMPDMPSNADWLIFVNEVEAVAEQMPAEVVGSVAVWKAKCRNVAVLGQEMCTTAAHIGELTYQIKVEEMLQEIAQRQANRLESLTPANLSSYTEMLSEIDMRTTRLLLQLIRLLHIQNAAIKYEYLYAAGEQLNSWPVSMDTVWSMLLQQENSALVGLLDLGPSNDFTRSFVIQGIPIGLLVDGNDWQFSIPVEDSPTFPIGYSRVRIRYVELRFDQGTSDEGRMIHQPSTSSGLTYMLLQSSPVFRDRRRREVLEYEASMGLAYAFAYNLTTGVPTLTNVPSPEFANTFMRMTPFNSNWRLRLSSSAMENQGLMFPTASSADDTTQITITFFISAIRGIDTRAAVEI

SEQ ID NO: 92 - protein, 893 aa, Nephrolepis falcate
MQQSVHIAARMPGDGEKGRFSSDEEHQMMMRPRLTSNVPEDYEAIYAGSNSITREVGVNKVRCGELMAIHQMFFRLDTLSQELLQQPQLVKHLIVVADVVEIEGSRGTLVLPGSSLVLIFCRILVLKSKDVVLDLGSWDLSVATTSSPLVRCSIRAQQVVISSGSLSASLLIQAKHRLRWSDGSHLDQYFGRPFSFASSKINSFATTTTQTSYAKQSISTWPGVPPTSNLIVVNSETFNVRVNAVPWKGVVDCQTALPSSDDLLHPHVISGIQSTLLIVETILNFQTSNPSIIVLAQQHAQWIVDSLLQAVHLPNSTTGVPELKTLLARSQMVVKLPIDGSQHLKVPLLVYGEFQEDIDQLLRNAEAYDQEYRQLTRFVQQVQIIGSEFLQLSMSLAQKERQIETFQSLLVIRKQSELDQTMRRIDSLMREIERRSFEMADARYRMEEGVLDHYRRQVNRAVFGMLGALLQLFASLKFGGGADIAGAMETTVSAAIDIIHAVEDASASSKLLPMTKNLIDLEKMIEVVNAVNELVENATELEDIIHAPELPIISSYTWDILENDIDELAALMPSEVSEVVTWKAKCRNLVAVCREICIAANFAAEVQYELFVHARQQEMARRQAERLEGMQLATDLSSYIELATQADMRTTRLLLSLLNVLADHQGALHYHYLMELQVFTFTWPSVDSVRMHLLRLNQWARARENMLFGPGVLTVEVQQDYVVDAIPMSLLLSGEDWSFTINPGQNASVFPAPWDYVRIRYVEMKFTGEHHPVSQTGEVYLLLQSSANFQDRFEGQVLEYEAAVPLVYQYAYNLTTGATTLPNLPFESGKFFRMTPFTRWRLRLSASAYQNEGISFPTANSSDTSIQITITFYVTALPQIQSLSEDPAVATTL

SEQ ID NO: 93 - protein, 858 aa, Colysis wrightii 'Monstifera'
MERAIPDYSHLYRELNQVSERIRMDQMEFSEVMVIHRMFIKFPDLGIAHLEGADKVKCLYVFADVVELGSVRQTSSLPGSIMVVIMCRVLTLHLDSAAQAYRIDLPHMRLHAINDAQRLRIHRRNSDSLHDDYPVITISANVIEFSGTRSLRDIFGIGPLQDPSMIITNTETQPPVVERPSINSLCTVGLVQGQSSSPVTVDPDRISRHFWFQSVGGGALGTLRAAEGFSLFQRDLPDVLLIDPNILLCMQTSMLVAELVEFSHPSSDIHSAVTEHVVWLNTHLLQASTKAQGTSSHDDYLALIFRAQYLLKGMGRARSLVVPQLQYDVYRNLINQMARVAESYDQSLKQLQLFLAQNKILGGYLLEQNRAFAAKERDMEVFHSELIAQKELELQNTMFKMEQLSSQMETQIADMDQAEKDMEAGLRRFQNRQVARAMFAVFRAIGAVALTVVTGGAAAPAAMTAAKGAVSIAGQAARGLERVLEILDNLQAAMEVFKIIKDLVESLREVGQLVDAPEMPDMPTEADWSIFVNEVEAVAEQMPEEVSEVSAWKTSCKNVAAVGRELTTTSAYISQLQYDIKVQAMLQDIASRQADRLLSIQAADLSSYTEMVTQMDMRTTRLLMELIKVLDMQNAALMYQFLSLPAPMNAWPVTMETVWGMLVQHEHAAVLGLMRLGPAFDFRRTFVVKEIPVDLLLHGEDWQFEIPVNELTVFPGTWSQVRIHHLEMKFVGTAEGSAPNGAHQPITESGEVYILLQGSRVFHDRNKTEPLHYEAAVPLDYHYAYHLKTGETTLSNSPSNDFIRTFMRMTPFTTWRLRVSASAQENQGLAFPTTTVGAGDTTQIAVTLYVSAIREISL

SEQ ID NO: 94 - protein, 824 aa, Colysis wrightii
MVIHRMFFKLPDLDIAHLDGADKVKCLYVFADVVELGSAGQTSNLPGSIMVVIMCRVLTLHADWSRTSYRFVFPHMRLHAIFDLQQARIHRRNSDSVHDDYPVITISANVIEFSGTRSSSVLFGIGVFLDPSMVLSSDRHSIVERPSSHTLCNVNPVEQSSPIMVDPDTIRFQSIFNWVGSNIMSPQVARAPEGFSLFRRDLPDLLLIDPNILLCMQTSMLIAELVEFSHPSSDIHAAVTEHLIWLNTHLLQASTKAQGTSSYDDYLALIFRSQYLLKGMGRARSLVVPQLQYDVYRNLINQMARVAESYDQSLKQLQLFLAQNKVLGGYLLEQNRAFAAKERDMEVFHSELIAQKELELQNTMFKMEQLSSQMETQIADMDQAEKDMEAGLRRFQNRQVARAIFAVFRAIGAVALTVVTGGAAAPAAMSAAKGAVSIAGQAARGLERVLEILDNLQAAMEVFKIIKDLVESLREVGQLVDAPEMPDMPTEADWSIFVNEVEAVAEQMPEEVSEVSAWKTSCKNVAAVGRELTTTSAYISQLQYDIKVQAMLQDIANKQADRLSSIQAADLSSYTEMVTQMDMRTTRLLMELIKVLDMQNAALMYQFLTLPAPMNAWPVTMETVWGMLVQHEHAAVLGLMRLGPAFDFRRTFIVKEIPVDLLLHGEDWQFEIPVNELTVFPGTWSQVRIHHLEMKFVGTAEGSAPNGAHLPITESGEVYILLQGSRVFHDRNKTEPLHYEAAVPLDYHYAYHLKTGETTLSNSPSNDFIRTFMRMTPFTTWRLRVSASAQENQGLAFPTTTVGAGDTTQIAVTFYVSAIREISL

SEQ ID NO: 95 - protein, 884 aa, Colysis wrightii
VNQVSLRFQNMEFSEVMVVHRMHVRLEELDMTGVEGIEKVKHLYVLADVVELPPKATSVFEYVRLPATISAIILCRVLYIPEVQRLSGAGFRGQCSLDFPFMRLHVVGAAHESGGGVMQAFSSDATAGNIGVYLHADRFIYREAASPASDFVWPLDVRVSFGSSTFSNTAVPDWQNLNVSSIRYDSQRLSKGPPLTSSDSDLQRSDEIELLAQQDIWSPILHVSFNPNAPPGNVPGTQGLFRPSSACSFFHVPPPDVPANVLTDPSIILGMQMNMLIAELVLAAHNSPQVMNVVTKHVLWLNKILLQVASPNDDILALLFRIQAFMKMAKQPRFVPRFVVPRLQYHMYGSLINRMVQVAQNYDQEFKQLKLFIAQNEILGSYLLQQNKAFAEREKEMSAFHSQVVSMRRSELTTAIETMNQLSLQMETESEAMNEAQENMVEAIQEYERKLLARALFSVIGAIASVALAVATGGATAPGAVAAARGAVTAAGRLAQGLQKVVDILQGLQAVMEVVVAIRDIVESLKNMGQLVEAPEMPEMPTDADWLIFVNEVEAVAEQVPTEVAEVPVWKAKCKNVAVLGQAMCTTAAYMSELQYQITVEEMLQEIAQRQADRLVGISAADLSSYTEMASQIDMRTTRILLELIKMLYIQNAAIKYEYLYDANEKLNSWPVSMETVWTMLLRQENAALLGLLNLGPSNDFTVTYAVKDIPVKLLVDGYDWNFEIAVEDFSIFPSGWSRVRIRYVELKFDQQGTDSSNIVIHQPSTNTGLVYMLLQGSRFLHDRKREEVMDYEASMGAVFAYAYDLNTGATTLSNIPSQQHANTFMQMTPFNAAWRLRLSASAMENQGLVFPTATSPDNTTQISITFYVTAIRRIDHRQEGDEE

SEQ ID NO: 96 - protein, 810 aa, Bolbitis cladorrhizans
MAGIDYSVLYQDVNQISIRLEKMDFSEVMAVHRMFVRMDDLDVSSGTGLLAGAEKVKRLYVFADVVELPSKRVRLPGTDMIIILCRIFVVNGRHSTELFLPSMNLNMVAAGTGSIRGAYLSTTAFSLSSNALQFKLQSGSMTSAIQLKDVDLAATLTCDVQAASASMPIVVKTTGTSPGNILVLGMSTAVVIPESAVAVITDANILLGMQVTVLIAELVKTAHNSDVVIAAVTRHVEWLNHLLVQAHAAAPSDDVVALLYRTQGFIKLQREDLVVPGLQYRMYKDLINRMVQVAQSYDQDFKQLKLYVEQNKILGSYLLEQNKAFAEKEKDMDAFHSQVIALRTTELNNTIERMDDLSKQMEEQNAAMEQAKADMDAGLIEYQNKQVANAVFAVLGAIASIGLAFATGGATAPGAVAAAGTAVTAAGKAAEGLKKVVEILEGLQAVMEVVAAIKELVQSLQEIGQLVNAPEMPDLPSNAEWDIFVNEVEAVAEQMPTEVTEVPAWKAKCKNVAALGREMSTMAAHISELQFEIKVQEMLREIAQKQADRLSSIKPADLTNYLEMVSEMDMRTTRMLLELIKVLYIQNAALQYEYLQTPARLNAWPVTMQTVWTLLVQQETTAITGLLQLGAPSDYTQGYVVENIPVSLLLEGRDWEFELPVMNADFPTTWCRVRIHHVEMQFDAGAKHLPSTSTGQVYMLLQSSRFFADRAKRANEYINYQAGTGLYYQYAYRLATGEATVTNIPSEEYANTFMRLAPFTRWRLRLSASADENKGLAFPTATSADATTQIKITFHVSAIRRISTFVADPK

SEQ ID NO: 97 - protein, 851 aa, Bolbitis cladorrhizans
MASLPDYYEIYKNVNQVSRPVASRQASEVTSIHRMYFKLNLLEVALLTKADEVKELVVFADVVEMEGGKVELPASRIVTIVCRILSLKREDVELGFKFLGPVECEEGWQVGLNSEMAYIRRTSPQVRLSIYAQEVVHNSTGAILRVTHPVTVRQRVSPHRPSQYTPGTMKWQINISSAHADLSTAQRSHELRTQRFWSEPERTWLINPQEWSPFTFFLPPGLLPLAILGDSNIMLGMQSTLLIAELVLSYQTHAQATVSAAHRHLQWLTTNLVQVLDDDSLENEIREQLLALLARAELASKLPLDGSQNLIVPRLEYGQYRGLISSMAAVAEAYNSEFTAVNLFIQQNEILGSYLLQQNKAFAAREKDMEAFHGLVVERKRQELSSAQETMEELNVQLTQQTEAMDQAKEDMEAGLKKYRDAQAARAFFAVMKGVLEIGAAIFTGGATMGLAVQGGINAVKAVSSLAGKLDMVLQIMEGMEKVMEVLNAIDDLVAAVSEINKMVEAPEMPSMPSTHEWDIFENEIEEVAESMPEEVTEARTWRTKCRNVAAVCRAISTTASYIGQLQYELFVHSNQELIARRQAERLEAIQPADLTNSLEMATQLDMRTSRMLLNLLKVLTLQSGALQFHFLLPPTPFTGWVNMGMVRNALVKHEADAVAAQERLGPSTDYVRTYVMSGIPVSLLLDGDDWIFTINPLDGSTFPLSWSRVRIRYLEMKFTGGEEFHKPTTDSGKVYMLLQASRNFQDRLRREVLHYEAAVPLQYQYAYHLTTGETTVENRPSQQHHGEYMQMTPFGQWRLRLSASAFENRNLAFPTAANTDLDAATTQISITFFVTAVRAVDFRSLDDQDM

SEQ ID NO: 98 - protein, 899 aa, Blechnum brasiliense 'Crispum'
MQGRLASMAGSAGAADAWREVYRDLNQVSDRIRLDQLEFSEVMVIHRMHIKMSELDLGHLEGAEKVERLYVFADVVELDVVPHESSSDGDVVVRLPGSKSVTFVCRVWHINYALVQISSFARISRSVVLELRHMRWHFNAITGRMHLLDPQTLQDGMDLCFCVHAEVVQIAYYPDVTFPESNDSPSFLRFLRLEIVPDQLRVTTQTDGPVWALRGALEYFMAPDNDGLLNEVSSQPAGTSFVLNILPDNLDVQLFANLRPNSGTTLTRDPNTIVPAFSVYKEKEGELLSDPNILPAMQTSMLIGELVEVGQPPSVTTEVVRKHVEWLNNLLLQVIEAKRGEHVEDYVELSFRAQYVIKKVGRIQRLVVPQLQYSAYSNLINRLAQVAESYDQALRQFRLFIQQNKILGGFLLEQNRAFAEKEQDMDVFYSELIAQRQIELDNTLQKMKHLGAQMETQTADMEQAQADMEAGIREFQNRQVARGLFAVLGAIAAVGLTLLTGGAAAPLAMSAARSAVSLAGAVAQGLQRVLDILEGLQVVMEVVELINDLISSLQELGQPVELPEMAEMPTEADWLIFVNEVEGVAEQMPTEVSEVVAWKTKCKNVAVLGREMTTLAAYISQLQYDINMQHMLQQIARKQADRLSAIELPDLRNYGELVTQMDMRTTRLLVALIKVVNIQNAALMYQYLSEPTPVYAWPVNMDSVWRMLVQHEQFAIQGLMRLGPAFDIVRTYEVKGIPVSLLLDGDDYEFEIPAQDHVTFPLSLSRVRIHHLEMKFVQGEGDQLHMPVTDTGSVYILLQGSRNFHDRSEGTILHYEAATSLDYHFAYRLDTGETTVTNLPSAEFLRTFMRMTPFTNWRLRVSASAEENKGLAFPTATSADATTHIAITFFISAIRQIAL

SEQ ID NO: 99 - protein, 50 aa, Artificial Sequence
  PtIP-50 amino acid Motif
  MISC_FEATURE (4)..(4): Xaa at position 4 is Ala, Thr or Ser
  MISC_FEATURE (5)..(5): Xaa at position 5 is Lys or Ser
  MISC_FEATURE (7)..(7): Xaa at position 7 is Lys or Arg
  MISC_FEATURE (11)..(11): Xaa at position 11 is Ala, Val, Ile or Leu
  MISC_FEATURE (12)..(12): Xaa at position 12 is Leu, Val or Ile
  MISC_FEATURE (14)..(14): Xaa at position 14 is Arg, Gln, Lys or Asn
  MISC_FEATURE (16)..(16): Xaa at position 16 is Met, Ala, Ile or Val
  MISC_FEATURE (17)..(17): Xaa at position 17 is Cys, Thr or Ser
  MISC_FEATURE (22)..(22): Xaa at position 22 is Tyr, His, Trp or Phe
  MISC_FEATURE (24)..(24): Xaa at position 24 is Ser, Ala or Thr
  MISC_FEATURE (25)..(25): Xaa at position 25 is Glu, Gln, Asp or Asn
  MISC_FEATURE (29)..(29): Xaa at position 29 is Asp, Glu, Gln or Asn
  MISC_FEATURE (31)..(31): Xaa at position 31 is Gln, Lys, Asn or Arg
  MISC_FEATURE (34)..(34): Xaa at position 34 is Ala, Glu or Asp
  MISC_FEATURE (38)..(38): Xaa at position 38 is Glu, Asp, Gln or Asn
  MISC_FEATURE (40)..(49): Xaa at position 49 is Ser, Gly, Ala or Thr
  MISC_FEATURE (41)..(41): Xaa at position 41 is Arg, Gln, Lys or Asn
  MISC_FEATURE (45)..(45): Xaa at position 45 is Asp or Glu
  MISC_FEATURE (48)..(48): Xaa at position 48 is Ser, Glu, Thr or Asp
AWKXXCXNVAXXGXEXXTTAAXIXXLQYXIXVQXMLQXIAXXQAXRLXXI

SEQ ID NO: 100 - protein, 43 aa, Artificial Sequence
  PtIP-50 amino acid Motif
  MISC_FEATURE (1)..(1): Xaa at position 1 is Glu, Gln, Asp or Asn
  MISC_FEATURE (2)..(2): Xaa at position 2 is Ser, Ala or Thr
  MISC_FEATURE (6)..(6): Xaa at position 6 is Glu, Ser, Asp or Thr
  MISC_FEATURE (7)..(7): Xaa at position 7 is Leu, Phe, Ile or Val
  MISC_FEATURE (8)..(8): Xaa at position 8 is Lys or Arg
  MISC_FEATURE (10)..(10): Xaa at position 10 is Leu, Phe, Ile or Val
  MISC_FEATURE (11)..(11): Xaa at position 11 is Lys or Gln
  MISC_FEATURE (14)..(14): Xaa at position 14 is Ile, Val or Leu
  MISC_FEATURE (15)..(15): Xaa at position 15 is Ala, Gln or Asn
  MISC_FEATURE (18)..(18): Xaa at position 18 is Lys, Glu, Arg or Asp
  MISC_FEATURE (22)..(22): Xaa at position 22 is Ser, Gly or Thr
  MISC_FEATURE (26)..(26): Xaa at position 26 is Glu, Gln, Asp or Asn
  MISC_FEATURE (29)..(29): Xaa at position 29 is Arg or Lys
  MISC_FEATURE (33)..(33): Xaa at position 33 is Glu, Ala or Asp
  MISC_FEATURE (34)..(34): Xaa at position 34 is Lys or Arg
  MISC_FEATURE (36)..(36): Xaa at position 36 is Arg or Lys
  MISC_FEATURE (39)..(39): Xaa at position 39 is Glu or Asp
  MISC_FEATURE (40)..(40): Xaa at position 40 is Val, Ala, Ile or Leu
XXYDQXXXQXXLFXXQNXILGXYLLXQNXAFAXXEXDMXXFHS

SEQ ID NO: 101 - protein, 38 aa, Artificial Sequence
  PtIP-50 amino acid Motif
  MISC_FEATURE (2)..(2): Xaa at position 2 is His, Arg or Lys
  MISC_FEATURE (6)..(6): Xaa at position 6 is Glu, Lys, Asp or Arg
  MISC_FEATURE (7)..(7): Xaa at position 7 is Thr, Ala, Ser, Gly, Glu, Arg, Asp, Asn, Lys or Gln
  MISC_FEATURE (9)..(9): Xaa at position 9 is Val, Pro, Ile or Leu
  MISC_FEATURE (11)..(11): Xaa at position 11 is His, Arg, Lys, Asp or Glu
  MISC_FEATURE (15)..(15): Xaa at position 15 is Ala or Gly
  MISC_FEATURE (16)..(16): Xaa at position 16 is Thr, Ser, Ile, Leu or Val
  MISC_FEATURE (17)..(17): Xaa at position 17 is Pro or Gly
  MISC_FEATURE (19)..(19): Xaa at position 19 is Asp, Glu, Leu, Ile or Val
  MISC_FEATURE (21)..(21): Xaa at position 21 is His, Asn or Gln
  MISC_FEATURE (25)..(25): Xaa at position 25 is Asn, Gln, Lys or Arg
  MISC_FEATURE (30)..(30): Xaa at position 30 is Glu, Asp or Ala
  MISC_FEATURE (33)..(33): Xaa at position 33 is Leu, Ile or Val
  MISC_FEATURE (34)..(34): Xaa at position 34 is Thr or Ser
FXDRNXXEXLXYEAXXXLXYXYAYXLDTGXTTXXNLPS

SEQ ID NO: 102 - protein, 43 aa, Artificial Sequence
  PtIP-50 amino acid Motif
  MISC_FEATURE (4)..(4): Xaa at position 4 is Ser or Thr
  MISC_FEATURE (5)..(5): Xaa at position 5 is Ser, Thr, Gln or Asn
  MISC_FEATURE (6)..(6): Xaa at position 6 is Tyr, Trp or Phe
  MISC_FEATURE (9)..(9): Xaa at position 9 is Met, Ile, Leu or Leu
  MISC_FEATURE (10)..(10): Xaa at position 10 is Val, Ile, Leu or Ala
  MISC_FEATURE (11)..(11): Xaa at position 11 is Thr or Ser
  MISC_FEATURE (12)..(12): Xaa at position 12 is Gln, Asp, Asn or Glu
  MISC_FEATURE (20)..(20): Xaa at position 20 is Leu, Ile, Val or Met
  MISC_FEATURE (22)..(22): Xaa at position 22 is Leu, Ile or Val
  MISC_FEATURE (23)..(23): Xaa at position 23 is Glu, Asp or Ala
  MISC_FEATURE (29)..(29): Xaa at position 29 is His, Asn, Trp, Phe or Tyr
  MISC_FEATURE (30)..(30): Xaa at position 30 is Ile, Val, Leu or Met
  MISC_FEATURE (33)..(33): Xaa at position 33 is Ala, Gly, Ile, Leu or Val
  MISC_FEATURE (38)..(38): Xaa at position 38 is Gln, Asp, Asn or Glu
  MISC_FEATURE (42)..(42): Xaa at position 42 is Glu, Asp or Pro
  MISC_FEATURE (43)..(43): Xaa at position 43 is Pro or Ala
ADLXXXTEXXXXMDMRTTRXLXXLIKVLXXQNXALMYXYLSXX

SEQ ID NO: 103 - protein, 22 aa, Artificial Sequence
  PtIP-50 amino acid Motif
  MISC_FEATURE (4)..(4): Xaa at position 4 is Arg, Asn, Lys, Gln, Ser or Thr
  MISC_FEATURE (9)..(9): Xaa at position 9 is Leu, Ile or Val
  MISC_FEATURE (14)..(141): Xaa at position 14 Glu, Asp, Asn or Gln
  MISC_FEATURE (17)..(17): Xaa at position 17 is Glu, Lys, Asp, Arg, Asn or Gln
PFTXWRLRXSASAXENXGLAFP

SEQ ID NO: 104 - protein, 22 aa, Artificial Sequence
  PtIP-50 amino acid Motif
  MISC_FEATURE (3)..(3): Xaa at position 3 is Leu, Ile, Val, Glu or Asp
  MISC_FEATURE (6)..(6): Xaa at position 6 is Val, Ile Leu, Asp or Glu
  MISC_FEATURE (9)..(9): Xaa at position 9 is Val, Leu or Ile
  MISC_FEATURE (11)..(11): Xaa at position 11 is Ala or Gly
  MISC_FEATURE (14)..(14): Xaa at position 14 is Glu, Asp or Ala
  MISC_FEATURE (18)..(18): Xaa at position 18 is Thr, Ser, Asp or Glu
DWXIFXNEXEXVAXQMPXEVSE

SEQ ID NO: 105 - protein, 47 aa, Artificial Sequence
  PtIP-50 amino acid Motif
  MISC_FEATURE (2)..(2): Xaa at position 2 is Thr, Ser, Gln or Asn
  MISC_FEATURE (4)..(4): Xaa at position 4 is Glu, Asp, Asn or Gln
  MISC_FEATURE (8)..(8): Xaa at position 8 is Gly, Lys or Arg
  MISC_FEATURE (9)..(9): Xaa at position 9 is Met, Ile, Val or Leu
  MISC_FEATURE (11)..(11): Xaa at position 11 is Val, Leu or Ile
  MISC_FEATURE (13)..(13): Xaa at position 13 is His, Asn or Glu
  MISC_FEATURE (15)..(15): Xaa at position 15 is His, Asn or Gln
  MISC_FEATURE (18)..(18): Xaa at position 18 is Ile, Leu or Val
  MISC_FEATURE (19)..(19): Xaa at position 19 is Leu, Ile, Val, Asn or Gln
  MISC_FEATURE (22)..(22): Xaa at position 22 is Leu, Ile, Val or Met
  MISC_FEATURE (23)..(23): Xaa at position 23 is Arg, Lys, Asn or Gln
  MISC_FEATURE (26)..(26): Xaa at position 26 is Pro or Ala
  MISC_FEATURE (27)..(27): Xaa at position 27 is Ser, Ala, Thr or Pro
  MISC_FEATURE (28)..(28): Xaa at position 28 is Phe, Trp, Tyr, Thr or Ser
  MISC_FEATURE (30)..(30): Xaa at position 30 is Phe, Leu, Val or Ile
  MISC_FEATURE (31)..(31): Xaa at position 31 is Thr, Arg, Ser, Lys, Ile, Leu or Val
  MISC_FEATURE (34)..(34): Xaa at position 34 is Tyr, Trp or Phe
  MISC_FEATURE (42)..(42): Xaa at position 42 is Asp, Glu, Thr or Ser
  MISC_FEATURE (46)..(46): Xaa at position 46 is Asp, Glu or His
VXMXTVWXXLXQXEXAAXXGLXXLGXXXDXXRTXVVKDIPVXLLLXG

SEQ ID NO: 106 - protein, 28 aa, Artificial Sequence
  PtIP-50 amino acid Motif
  MISC_FEATURE (5)..(5): Xaa at position 5 is Gln, Asn, Arg or Lys
  MISC_FEATURE (13)..(13): Xaa at position 13 is Val, Ile, Leu or Ala
  MISC_FEATURE (14)..(14): Xaa at position 14 is Ile, Leu or Val
  MISC_FEATURE (18)..(18): Xaa at position 18 is Phe, Tyr, Trp or His
  MISC_FEATURE (19)..(19): Xaa at position 19 is Ile, Val, Leu or Phe
  MISC_FEATURE (20)..(20): Xaa at position 20 is Arg or Lys
  MISC_FEATURE (21)..(21): Xaa at position 21 is Leu, Ile, Val or Met
  MISC_FEATURE (22)..(22): Xaa at position 22 is Asp, Glu or Pro
  MISC_FEATURE (23)..(23): Xaa at position 23 is Asp or Glu
  MISC_FEATURE (26)..(26): Xaa at position 26 is Ile, Val or Leu
  MISC_FEATURE (27)..(27): Xaa at position 27 is Ala or Gly
  MISC_FEATURE (28)..(28): Xaa at position 28 is His, Ile, Val or Leu
IRLDXMEFSEVMXXHRMXXXXXXLDXXX

SEQ ID NO: 107 - protein, 50 aa, Artificial Sequence
  PtIP-50 amino acid Motif
  MISC_FEATURE (1)..(1): Xaa at position 1 is Ala, Ile, Val or Leu
  MISC_FEATURE (3)..(3): Xaa at position 3 is Arg, Lys, Asp or Glu
  MISC_FEATURE (4)..(4): Xaa at position 4 is Gly, Arg or Lys
  MISC_FEATURE (6)..(6): Xaa at position 6 is Gln, Lys, Asn, Arg, Asp or Glu
  MISC_FEATURE (7)..(7): Xaa at position 7 is Arg or Lys
  MISC_FEATURE (9)..(9): Xaa at position 9 is Leu, Ile or Val
  MISC_FEATURE (10)..(10): Xaa at position 10 is Glu, Asn, Asp or Gln
  MISC_FEATURE (13)..(13): Xaa at position 13 is Glu or Asp
  MISC_FEATURE (14)..(14): Xaa at position 14 is Gly, Glu or Asp
  MISC_FEATURE (18)..(18): Xaa at position 18 is Val, Ile, Leu or Ala
  MISC_FEATURE (23)..(23): Xaa at position 23 is Ala, Arg or Lys
  MISC_FEATURE (24)..(24): Xaa at position 24 is Ala, Leu, Val or Ile
  MISC_FEATURE (26)..(26): Xaa at position 26 is Lys, Arg, Gln or Asn
  MISC_FEATURE (27)..(27): Xaa at position 27 is Asp or Glu
  MISC_FEATURE (35)..(35): Xaa at position 35 is Leu, Ile or Val
  MISC_FEATURE (40)..(40): Xaa at position 40 is Asp or Glu
  MISC_FEATURE (43)..(43): Xaa at position 43 is Glu or Asp
  MISC_FEATURE (46)..(46): Xaa at position 46 is Asp or Glu
  MISC_FEATURE (47)..(47): Xaa at position 47 is Met, Ile, Val or Leu
  MISC_FEATURE (49)..(49): Xaa at position 49 is Thr or Ser
XAXXLXXVXXILXXLQAXMEVVXXIXXLVESLQEXGQLVXAPXMPXXPXE

SEQ ID NO: 108 - protein, 22 aa, Artificial Sequence
  PtIP-50 amino acid Motif
  MISC_FEATURE (1)..(1): Xaa at position 1 is Thr, Ser, Ile, Leu or Val
  MISC_FEATURE (4)..(4): Xaa at position 4 is Leu, Ile, Val, Thr or Ser
  MISC_FEATURE (5)..(5): Xaa at position 5 is Thr or Ser
  MISC_FEATURE (6)..(6): Xaa at position 6 is Trp, Tyr, Phe, Val, Ile or Leu
  MISC_FEATURE (12)..(12): Xaa at position 12 is His, Lys or Arg
  MISC_FEATURE (13)..(13): Xaa at position 13 is His, Trp, Phe or Tyr
  MISC_FEATURE (14)..(14): Xaa at position 14 is Leu, Val or Ile
  MISC_FEATURE (19)..(19): Xaa at position 19 is Val, Ile, Leu, Glu or Asp
  MISC_FEATURE (20)..(20): Xaa at position 20 is Gly, Gln, Asn or Ala
  MISC_FEATURE (21)..(21): Xaa at position 21 is Ala or Gly
XFPXXXSRVRIXXXEMKFXXXA

SEQ ID NO: 109 - protein, 26 aa, Artificial Sequence
  PtIP-50 amino acid Motif
  MISC_FEATURE (1)..(1): Xaa at position 1 is Arg or Lys
  MISC_FEATURE (3)..(3): Xaa at position 3 is Val, Ile or Leu
  MISC_FEATURE (5)..(5): Xaa at position 5 is Arg or Asn
  MISC_FEATURE (7)..(7): Xaa at position 7 is Leu, Ile or Val
  MISC_FEATURE (11)..(11): Xaa at position 11 is Leu, Ile, Val or Phe
  MISC_FEATURE (12)..(12): Xaa at position 12 is Gly, Lys or Arg
  MISC_FEATURE (15)..(15): Xaa at position 15 is Ala or Gly
  MISC_FEATURE (16)..(16): Xaa at position 16 is Ala, Thr or Ser
  MISC_FEATURE (17)..(17): Xaa at position 17 is Val, Leu or Ile
  MISC_FEATURE (18)..(18): Xaa at position 18 is Ala or Gly
  MISC_FEATURE (20)..(20): Xaa at position 20 is Ala, Ser or Thr
  MISC_FEATURE (21)..(21): Xaa at position 21 is Phe, Val, Ile or Leu
  MISC_FEATURE (22)..(22): Xaa at position 22 is Ala, Leu, Ile or Val
XQXAXAXFAVXXAIXXXXLXXXTGGA

SEQ ID NO: 110 - protein, 36 aa, Artificial Sequence
  PtIP-50 amino acid Motif
  MISC_FEATURE (1)..(1): Xaa at position 1 is Gln, Asn, Ile, Val or Leu
  MISC_FEATURE (2)..(2): Xaa at position 2 is Arg or Lys
  MISC_FEATURE (3)..(3): Xaa at position 3 is Gln, Arg, Asn, Thr, Ser or Thr
  MISC_FEATURE (4)..(4): Xaa at position 4 is Ser, Thr, Leu, Val or Ile
  MISC_FEATURE (7)..(7): Xaa at position 7 is Asp, Glu, Asn or Gln
  MISC_FEATURE (9)..(9): Xaa at position 9 is Thr, Ser or Ala
  MISC_FEATURE (10)..(10): Xaa at position 10 is Ile, Met, Val or Leu
  MISC_FEATURE (11)..(11): Xaa at position 11 is Gln, Asp, Asn or Glu
  MISC_FEATURE (12)..(12): Xaa at position 12 is Lys or Arg
  MISC_FEATURE (13)..(13): Xaa at position 13 is Met, Val, Leu or Ile;
  MISC_FEATURE (23)..(23): Xaa at position 23 is Gln, Asp, Asn or Glu
  MISC_FEATURE (25)..(25): Xaa at position 25 is Ala, Asp or Glu
  MISC_FEATURE (26)..(26): Xaa at position 26 is Asp, Glu or Ala
  MISC_FEATURE (28)..(28): Xaa at position 28 is Glu or Asp
  MISC_FEATURE (31)..(31): Xaa at position 31 is Lys, Gln, Asn or Arg
  MISC_FEATURE (32)..(32): Xaa at position 32 is Ala, Asp or Glu
  MISC_FEATURE (35)..(35): Xaa at position 35 is Glu or Asp
  MISC_FEATURE (36)..(36): Xaa at position 36 is Ala, Asp or Glu
XXXXELXNXXXXXDQLSLQMETXSXXMXQAXXDMXX

SEQ ID NO: 111 - protein, 22 aa, Artificial Sequence
  PtIP-50 amino acid Motif
  MISC_FEATURE (5)..(5): Xaa at position 5 is Gln, Asn, Lys or Arg
  MISC_FEATURE (9)..(9): Xaa at position 9 is Asp, Glu or His
  MISC_FEATURE (16)..(16): Xaa at position 16 is Asn, Gln, Glu or Asp
  MISC_FEATURE (17)..(17): Xaa at position 17 is Arg, Lys, Asn or Gln
  MISC_FEATURE (18)..(18): Xaa at position 18 is Met, Ile, Val or Leu
  MISC_FEATURE (19)..(19): Xaa at position 19 is Ala, Ile, Leu or Val
  MISC_FEATURE (20)..(20): Xaa at position 20 is Gln, Asn, Lys or Arg
LVVPXLQYXMYSNLIXXXXXVA

SEQ ID NO: 112 - protein, 31 aa, Artificial Sequence
  PtIP-50 amino acid Motif
  MISC_FEATURE (1)..(1): Xaa at position 1 is Pro or Ala
  MISC_FEATURE (2)..(2): Xaa at position 2 is Asp, Glu, Leu, Ile or Val
  MISC_FEATURE (4)..(4): Xaa at position 4 is Leu, Ile or Val;
  MISC_FEATURE (9)..(9): Xaa at position 9 is Asn, Gln, Thr or Ser
  MISC_FEATURE (10)..(10): Xaa at position 10 is Ile, Leu or Val
  MISC_FEATURE (11)..(11): Xaa at position 11 is Leu, Val or Ile
  MISC_FEATURE (12)..(12): Xaa at position 12 is Leu, Ile, Val, Thr or Ser
  MISC_FEATURE (13)..(13): Xaa at position 13 is Gly or Cys
  MISC_FEATURE (17)..(17): Xaa at position 17 is Ser or Thr
  MISC_FEATURE (18)..(18): Xaa at position 18 is Met, Ile, Val or Leu
  MISC_FEATURE (25)..(25): Xaa at position 25 is Glu, Asp, Ile, Val or Leu
  MISC_FEATURE (26)..(26): Xaa at position 26 is Phe, Ile, Leu or Val
  MISC_FEATURE (27)..(27): Xaa at position 27 is Ala, Thr or Ser
  MISC_FEATURE (28)..(28): Xaa at position 28 is His, Asn or Gln
  MISC_FEATURE (29)..(29): Xaa at position 29 is Pro, Gln or Asn
XXAXLTDPXXXXXMQTXXLIAELVXXXXXSS

SEQ ID NO: 113 - protein, 22 aa, Artificial Sequence
  PtIP-50 amino acid Motif
  MISC_FEATURE (1)..(1): Xaa at position 1 is Ala, Ser or Thr
  MISC_FEATURE (2)..(2): Xaa at position 2 is Thr, Ser, Ile, Leu or Val
  MISC_FEATURE (3)..(3): Xaa at position 3 is Ser, Thr or Gly
  MISC_FEATURE (5)..(5): Xaa at position 5 is Asp, Glu or Gly
  MISC_FEATURE (6)..(6): Xaa at position 6 is Ala, Glu or Asp
  MISC_FEATURE (15)..(15): Xaa at position 15 is His, Tyr, Trp or Phe
  MISC_FEATURE (16)..(16): Xaa at position 16 is Val, Leu or Ile
  MISC_FEATURE (17)..(17): Xaa at position 17 is Ser or Thr
  MISC_FEATURE (21)..(21): Xaa at position 21 is Arg, Lys, Asn, Asp, Gln or Glu
XXXAXXTTQIAITFXXXAIRXI

SEQ ID NO: 114 - protein, 22 aa, Artificial Sequence
  PtIP-50 amino acid Motif
  MISC_FEATURE (5)..(5): Xaa at position 5 is Asp or Glu
  MISC_FEATURE (20)..(20): Xaa at position 20 is Pro, Asp or Glu
  MISC_FEATURE (21)..(21): Xaa at position 21 is Ser, Thr or Gly
LEGAXKVKRLYVFADVVELXXK

SEQ ID NO: 115 - protein, 16 aa, Artificial Sequence
  PtIP-50 amino acid Motif
  MISC_FEATURE (2)..(2): Xaa at position 2 is Ile, Leu or Val
  MISC_FEATURE (5)..(5): Xaa at position 5 is Thr or Ser
  MISC_FEATURE (8)..(8): Xaa at position 8 is Val, Leu or Ile
  MISC_FEATURE (10)..(10): Xaa at position 10 is Ile, Leu, Val or Met
  MISC_FEATURE (14)..(14): Xaa at position 14 is Ser, Thr or Gly
PXTDXGEXYXLLQXSR

SEQ ID NO: 116 - protein, 21 aa, Artificial Sequence
  PtIP-50 amino acid Motif
  MISC_FEATURE (2)..(2): Xaa at position 2 is Val, Ile or Leu
  MISC_FEATURE (3)..(3): Xaa at position 3 is Arg, Lys, Thr or Ser
  MISC_FEATURE (7)..(7): Xaa at position 7 is Ser or Thr
  MISC_FEATURE (8)..(8): Xaa at position 8 is Ile, Leu or Val
  MISC_FEATURE (9)..(9): Xaa at position 9 is Met, Thr or Ser
  MISC_FEATURE (16)..(16): Xaa at position 16 is Val, Leu or Ile
  MISC_FEATURE (18)..(18): Xaa at position 18 is His, Ile, Leu or Val
  MISC_FEATURE (19)..(19): Xaa at position 19 is Leu, Ile or Val
  MISC_FEATURE (21)..(21): Xaa at position 21 is Gly, Thr or Ser
TXXLPGXXXVVILCRXLXXNX

SEQ ID NO: 117 - protein, 22 aa, Artificial Sequence
  PtIP-50 amino acid Motif
  MISC_FEATURE (1)..(1): Xaa at position 1 is Ala, Ile, Leu or Val
  MISC_FEATURE (3)..(3): Xaa at position 3 is Thr or Arg
  MISC_FEATURE (4)..(4): Xaa at position 4 is Lys or Arg
  MISC_FEATURE (6)..(6): Xaa at position 6 is Val, Ile, Leu or Ala
  MISC_FEATURE (11)..(11): Xaa at position 11 is Lys or Thr
  MISC_FEATURE (14)..(14): Xaa at position 14 is Leu, Ile or Val
  MISC_FEATURE (16)..(16): Xaa at position 16 is Ala or Val
  MISC_FEATURE (22)..(22): Xaa at position 22 is Gly, Thr or Ser
XVXXHXEWLNXLLXQXSAAAQX

SEQ ID NO: 118 - protein, 16 aa, Artificial Sequence
  PtIP-50 amino acid Motif
  MISC_FEATURE (1)..(1): Xaa at position 1 is Tyr or Val
  MISC_FEATURE (2)..(2): Xaa at position 2 is Leu, Ile or Val
  MISC_FEATURE (6)..(6): Xaa at position 6 is Phe, Trp or Tyr
  MISC_FEATURE (8)..(8): Xaa at position 8 is Ala, Ser or Thr
  MISC_FEATURE (10)..(10): Xaa at position 10 is Tyr, Trp, Phe or Ala
  MISC_FEATURE (11)..(11): Xaa at position 11 is Leu, Val, Ile or Phe
  MISC_FEATURE (12)..(12): Xaa at position 12 is Ile, Val or Leu
  MISC_FEATURE (14)..(14): Xaa at position 14 is Leu, Gly, Ile, Val or Met
  MISC_FEATURE (16)..(16): Xaa at position 16 is Gly, Arg or Lys
XXALLXRXQXXXKXVX

SEQ ID NO: 119 - protein, 16 aa, Artificial Sequence
  PtIP-50 amino acid Motif
  MISC_FEATURE (3)..(3): Xaa at position 3 is Gly, Ala, Ile, Val or Leu
  MISC_FEATURE (5)..(5): Xaa at position 5 is Val, Ile, Leu or Met
  MISC_FEATURE (6)..(6): Xaa at position 6 is Ala, Thr or Ser
  MISC_FEATURE (9)..(9): Xaa at position 9 is Lys, Gly or Arg
  MISC_FEATURE (10)..(10): Xaa at position 10 is Gly or Ala
  MISC_FEATURE (13)..(13): Xaa at position 13 is Ser or Thr
  MISC_FEATURE (14)..(14): Xaa at position 14 is Ala, Leu or Ile
APXAXXAAXXAVXXAG

SEQ ID NO: 120 - protein, 12 aa, Artificial Sequence
  PtIP-50 amino acid Motif
  MISC_FEATURE (1)..(1): Xaa at position 1 is Glu or Asp
  MISC_FEATURE (3)..(3): Xaa at position 3 is Trp, Phe or Tyr
  MISC_FEATURE (4)..(4): Xaa at position 4 is Glu, Asp, Asn or Gln
  MISC_FEATURE (7)..(7): Xaa at position 7 is Ile or Leu
XDXXFEXPVEDF

SEQ ID NO: 121 - protein, 12 aa, Artificial Sequence
  PtIP-50 amino acid Motif
  MISC_FEATURE (3)..(3): Xaa at position 3 is Glu, Asp or His
  MISC_FEATURE (7)..(7): Xaa at position 7 is Asp or Glu
  MISC_FEATURE (8)..(8): Xaa at position 8 is Leu, Ile or Val
  MISC_FEATURE (11)..(11): Xaa at position 11 is Val, Leu or Ile
YSXLYRXXNQXS

SEQ ID NO: 122 - protein, 9 aa, Artificial Sequence
  PtIP-50 amino acid Motif
  MISC_FEATURE (2)..(2): Xaa at position 2 is Ala, Val or Ile
  MISC_FEATURE (3)..(3): Xaa at position 3 is Asn, Gln, Lys or Arg
FXXTFMRMT

SEQ ID NO: 123 - protein, 50 aa, Artificial Sequence; identical to SEQ ID NO: 99
  PtIP-50 amino acid Motif
  MISC_FEATURE (4)..(4): Xaa at position 4 is Ala or Thr
  MISC_FEATURE (5)..(5): Xaa at position 5 is Lys or Ser
  MISC_FEATURE (7)..(7): Xaa at position 7 is Lys or Arg
  MISC_FEATURE (11)..(11): Xaa at position 11 is Ala or Val
  MISC_FEATURE (12)..(12): Xaa at position 12 is Leu or Val
  MISC_FEATURE (14)..(14): Xaa at position 14 is Arg or Gln
  MISC_FEATURE (16)..(16): Xaa at position 16 is Met or Ala
  MISC_FEATURE (17)..(17): Xaa at position 17 is Cys, Thr or Ser
  MISC_FEATURE (22)..(22): Xaa at position 22 is Tyr or His
  MISC_FEATURE (24)..(24): Xaa at position 24 is Ser or Ala
  MISC_FEATURE (25)..(25): Xaa at position 25 is Glu or Gln
  MISC_FEATURE (29)..(29): Xaa at position 29 is Asp, Glu or Gln
  MISC_FEATURE (31)..(31): Xaa at position 31 is Gln or Lys
  MISC_FEATURE (34)..(34): Xaa at position 34 is Ala or Glu
  MISC_FEATURE (38)..(38): Xaa at position 38 is Glu, Asp or Gln
  MISC_FEATURE (41)..(41): Xaa at position 41 is Arg or Gln
  MISC_FEATURE (42)..(42): Xaa at position 42 is Lys or Arg
  MISC_FEATURE (45)..(45): Xaa at position 45 is Lys or Arg
  MISC_FEATURE (48)..(48): Xaa at position 48 is Ser or Glu
  MISC_FEATURE (49)..(49): Xaa at position 49 is Ser, Gly or Ala

SEQ ID NO: 124 - protein, 43 aa, Artificial Sequence; identical to SEQ ID NO: 100
  PtIP-50 amino acid Motif
  MISC_FEATURE (1)..(1): Xaa at position 1 is Glu or Gln
  MISC_FEATURE (2)..(2): Xaa at position 2 is Ser or Ala
  MISC_FEATURE (6)..(6): Xaa at position 6 is Glu, Ser or Asp
  MISC_FEATURE (7)..(7): Xaa at position 7 is Leu or Phe
  MISC_FEATURE (8)..(8): Xaa at position 8 is Lys or Arg
  MISC_FEATURE (10)..(10): Xaa at position 10 is Leu or Phe
  MISC_FEATURE (11)..(11): Xaa at position 11 is Lys or Gln
  MISC_FEATURE (14)..(14): Xaa at position 14 is Ile or Val
  MISC_FEATURE (15)..(15): Xaa at position 15 is Ala or Gln
  MISC_FEATURE (18)..(18): Xaa at position 18 is Lys or Glu
  MISC_FEATURE (22)..(22): Xaa at position 22 is Ser or Gly
  MISC_FEATURE (26)..(26): Xaa at position 26 is Glu or Gln
  MISC_FEATURE (29)..(29): Xaa at position 29 is Arg or Lys
  MISC_FEATURE (33)..(33): Xaa at position 33 is Glu or Ala
  MISC_FEATURE (34)..(34): Xaa at position 34 is Lys or Arg
  MISC_FEATURE (36)..(36): Xaa at position 36 is Arg or Lys
  MISC_FEATURE (39)..(39): Xaa at position 39 is Glu or Asp
  MISC_FEATURE (40)..(40): Xaa at position 40 is Val or Ala

SEQ ID NO: 125 - protein, 38 aa, Artificial Sequence; identical to SEQ ID NO: 101
  PtIP-50 amino acid Motif
  MISC_FEATURE (2)..(2): Xaa at position 2 is His or Arg
  MISC_FEATURE (6)..(6): Xaa at position 6 is Glu or Lys
  MISC_FEATURE (7)..(7): Xaa at position 7 is Thr, Ala, Ser, Gly, Glu, Arg, Asp or Asn
  MISC_FEATURE (9)..(9): Xaa at position 9 is Val or Pro
  MISC_FEATURE (11)..(11): Xaa at position 11 is His or Glu
  MISC_FEATURE (15)..(15): Xaa at position 15 is Ala or Gly
  MISC_FEATURE (16)..(16): Xaa at position 16 is Thr or Val
  MISC_FEATURE (17)..(17): Xaa at position 17 is Pro or Gly
  MISC_FEATURE (19)..(19): Xaa at position 19 is Asp or Val
  MISC_FEATURE (21)..(21): Xaa at position 21 is His or Gln
  MISC_FEATURE (25)..(25): Xaa at position 25 is Asn or Arg
  MISC_FEATURE (30)..(30): Xaa at position 30 is Glu or Ala
  MISC_FEATURE (33)..(33): Xaa at position 33 is Leu or Val
  MISC_FEATURE (34)..(34): Xaa at position 34 is Thr or Ser

SEQ ID NO: 126 - protein, 43 aa, Artificial Sequence; identical to SEQ ID NO: 102
  PtIP-50 amino acid Motif
  MISC_FEATURE (4)..(4): Xaa at position 4 is Ser or Thr
  MISC_FEATURE (5)..(5): Xaa at position 5 is Ser or Asn
  MISC_FEATURE (6)..(6): Xaa at position 6 is Tyr or Phe
  MISC_FEATURE (9)..(9): Xaa at position 9 is Met or Leu
  MISC_FEATURE (10)..(10): Xaa at position 10 is Val or Ala
  MISC_FEATURE (11)..(11): Xaa at position 11 is Thr or Ser
  MISC_FEATURE (12)..(12): Xaa at position 12 is Gln or Glu
  MISC_FEATURE (20)..(20): Xaa at position 20 is Leu or Met
  MISC_FEATURE (22)..(22): Xaa at position 22 is Leu or Val
  MISC_FEATURE (23)..(23): Xaa at position 23 is Glu or Ala
  MISC_FEATURE (29)..(29): Xaa at position 29 is His, Asn or Tyr
  MISC_FEATURE (30)..(30): Xaa at position 30 is Ile or Met
  MISC_FEATURE (33)..(33): Xaa at position 33 is Ala, Gly or Val
  MISC_FEATURE (38)..(38): Xaa at position 38 is Gln or Glu
  MISC_FEATURE (42)..(42): Xaa at position 42 is Glu or Pro
  MISC_FEATURE (43)..(43): Xaa at position 43 is Pro or Ala

SEQ ID NO: 127 - protein, 22 aa, Artificial Sequence
  PtIP-50 amino acid Motif
  MISC_FEATURE (4)..(4): Xaa at position 4 is Arg, Asn or Thr
  MISC_FEATURE (9)..(9): Xaa at position 9 is Leu or Val
  MISC_FEATURE (14)..(14): Xaa at position 14 Glu or Gln
  MISC_FEATURE (17)..(17): Xaa at position 17 is Glu, Lys or Gln
PFTXWRLRXSASAXENXGLAFP

SEQ ID NO: 128 - protein, 22 aa, Artificial Sequence
  PtIP-50 amino acid Motif
  MISC_FEATURE (3)..(3): Xaa at position 3 is Leu or Asp
  MISC_FEATURE (6)..(6): Xaa at position 6 is Val or Glu
  MISC_FEATURE (9)..(9): Xaa at position 9 is Val or Ile
  MISC_FEATURE (11)..(11): Xaa at position 11 is Ala or Gly
  MISC_FEATURE (14)..(14): Xaa at position 14 is Glu or Ala
  MISC_FEATURE (18)..(18): Xaa at position 18 is Thr or Glu
DWXIFXNEXEXVAXQMPXEVSE

SEQ ID NO: 129 - protein, 47 aa, Artificial Sequence; identical to SEQ ID NO: 105
  PtIP-50 amino acid Motif
  MISC_FEATURE (2)..(2): Xaa at position 2 is Thr or Asn
  MISC_FEATURE (4)..(4): Xaa at position 4 is Glu, Asp or Gln
  MISC_FEATURE (8)..(8): Xaa at position 8 is Gly or Arg
  MISC_FEATURE (9)..(9): Xaa at position 9 is Met or Leu
  MISC_FEATURE (11)..(11): Xaa at position 11 is Val or Ile
  MISC_FEATURE (13)..(13): Xaa at position 13 is His or Glu
  MISC_FEATURE (15)..(15): Xaa at position 15 is His or Gln
  MISC_FEATURE (18)..(18): Xaa at position 18 is Ile or Val
  MISC_FEATURE (19)..(19): Xaa at position 19 is Leu or Gln
  MISC_FEATURE (22)..(22): Xaa at position 22 is Leu or Met
  MISC_FEATURE (23)..(23): Xaa at position 23 is Arg or Gln
  MISC_FEATURE (26)..(26): Xaa at position 26 is Pro or Ala
  MISC_FEATURE (27)..(27): Xaa at position 27 is Ser, Ala or Pro
  MISC_FEATURE (28)..(28): Xaa at position 28 is Phe or Ser
  MISC_FEATURE (30)..(30): Xaa at position 30 is Phe or Ile
  MISC_FEATURE (31)..(31): Xaa at position 31 is Phe or Ile
  MISC_FEATURE (34)..(34): Xaa at position 34 is Tyr or Phe
  MISC_FEATURE (42)..(42): Xaa at position 42 is Asp or Ser
  MISC_FEATURE (46)..(46): Xaa at position 46 is Asp or His

SEQ ID NO: 130 - protein, 28 aa, Artificial Sequence
  PtIP-50 amino acid Motif
  MISC_FEATURE (5)..(5): Xaa at position 5 is Gln or Lys
  MISC_FEATURE (13)..(13): Xaa at position 13 is Val or Ala
  MISC_FEATURE (14)..(14): Xaa at position 14 is Ile or Val
  MISC_FEATURE (18)..(18): Xaa at position 18 is Phe or His
  MISC_FEATURE (19)..(19): Xaa at position 19 is Ile, Val or Phe
  MISC_FEATURE (20)..(20): Xaa at position 20 is Arg or Lys
  MISC_FEATURE (21)..(21): Xaa at position 21 is Leu or Met
  MISC_FEATURE (22)..(22): Xaa at position 22 is Asp or Pro
  MISC_FEATURE (23)..(23): Xaa at position 23 is Asp or Glu
  MISC_FEATURE (26)..(26): Xaa at position 26 is Ile, Val or Leu
  MISC_FEATURE (27)..(27): Xaa at position 27 is Ala or Gly
  MISC_FEATURE (28)..(28): Xaa at position 28 is His or Leu
IRLDXMEFSEVMXXHRMXXXXXXLDXXX

SEQ ID NO: 131 - protein, 50 aa, Artificial Sequence; identical to SEQ ID NO: 107
  PtIP-50 amino acid Motif
  MISC_FEATURE (1)..(1): Xaa at position 1 is Ala or Leu
  MISC_FEATURE (3)..(3): Xaa at position 3 is Arg or Glu
  MISC_FEATURE (4)..(4): Xaa at position 4 is Gly or Lys
  MISC_FEATURE (6)..(6): Xaa at position 6 is Gln, Lys or Glu
  MISC_FEATURE (7)..(7): Xaa at position 7 is Arg or Lys
  MISC_FEATURE (9)..(9): Xaa at position 9 is Leu or Val
  MISC_FEATURE (10)..(10): Xaa at position 10 is Glu or Gln
  MISC_FEATURE (13)..(13): Xaa at position 13 is Glu or Asp
  MISC_FEATURE (14)..(14): Xaa at position 14 is Gly or Asp
  MISC_FEATURE (18)..(18): Xaa at position 18 is Val or Ala
  MISC_FEATURE (23)..(23): Xaa at position 23 is Ala or Lys
  MISC_FEATURE (24)..(24): Xaa at position 24 is Ala or Ile
  MISC_FEATURE (26)..(26): Xaa at position 26 is Lys or Asn
  MISC_FEATURE (27)..(27): Xaa at position 27 is Asp or Glu
  MISC_FEATURE (35)..(35): Xaa at position 35 is Leu, Ile or Val
  MISC_FEATURE (40)..(40): Xaa at position 40 is Asp or Glu
  MISC_FEATURE (43)..(43): Xaa at position 43 is Glu or Asp
  MISC_FEATURE (46)..(46): Xaa at position 46 is Asp or Glu
  MISC_FEATURE (47)..(47): Xaa at position 47 is Met or Leu
  MISC_FEATURE (49)..(49): Xaa at position 49 is Thr or Ser

SEQ ID NO: 132 - protein, 22 aa, Artificial Sequence
  PtIP-50 amino acid Motif
  MISC_FEATURE (1)..(1): Xaa at position 1 is Thr or Val
  MISC_FEATURE (4)..(4): Xaa at position 4 is Leu or Ser
  MISC_FEATURE (5)..(5): Xaa at position 5 is Thr or Ser
  MISC_FEATURE (6)..(6): Xaa at position 6 is Trp or Leu
  MISC_FEATURE (12)..(12): Xaa at position 12 is His or Arg
  MISC_FEATURE (13)..(13): Xaa at position 13 is His or Tyr
  MISC_FEATURE (14)..(14): Xaa at position 14 is Leu or Val
  MISC_FEATURE (19)..(19): Xaa at position 19 is Val or Asp
  MISC_FEATURE (20)..(20): Xaa at position 20 is Gly, Gln or Ala
  MISC_FEATURE (21)..(21): Xaa at position 21 is Ala or Gly
XFPXXXSRVRIXXXEMKFXXXA

SEQ ID NO: 133 - protein, 26 aa, Artificial Sequence
  PtIP-50 amino acid Motif
  MISC_FEATURE (1)..(1): Xaa at position 1 is Arg or Lys
  MISC_FEATURE (3)..(3): Xaa at position 3 is Val or Leu
  MISC_FEATURE (5)..(5): Xaa at position 5 is Arg or Asn
  MISC_FEATURE (7)..(7): Xaa at position 7 is Leu or Val
  MISC_FEATURE (11)..(11): Xaa at position 11 is Leu or Phe
  MISC_FEATURE (12)..(12): Xaa at position 12 is Gly or Arg
  MISC_FEATURE (15)..(15): Xaa at position 15 is Ala or Gly
  MISC_FEATURE (16)..(16): Xaa at position 16 is Ala or Ser
  MISC_FEATURE (17)..(17): Xaa at position 17 is Val or Ile
  MISC_FEATURE (18)..(18): Xaa at position 18 is Ala or Gly
  MISC_FEATURE (20)..(20): Xaa at position 20 is Ala or Thr
  MISC_FEATURE (21)..(21): Xaa at position 21 is Phe, Val or Leu
  MISC_FEATURE (22)..(22): Xaa at position 22 is Ala, Leu or Val
XQXAXAXFAVXXAIXXXXLXXXTGGA

SEQ ID NO: 134 - protein, 36 aa, Artificial Sequence; identical to SEQ ID NO: 110
  PtIP-50 amino acid Motif
  MISC_FEATURE (1)..(1): Xaa at position 1 is Gln or Leu
  MISC_FEATURE (2)..(2): Xaa at position 2 is Arg or Lys
  MISC_FEATURE (3)..(3): Xaa at position 3 is Gln, Arg or Thr
  MISC_FEATURE (4)..(4): Xaa at position 4 is Ser, Thr or Ile
  MISC_FEATURE (7)..(7): Xaa at position 7 is Asp or Gln
  MISC_FEATURE (9)..(9): Xaa at position 9 is Thr or Ala
  MISC_FEATURE (10)..(10): Xaa at position 10 is Ile, Met or Leu
  MISC_FEATURE (11)..(11): Xaa at position 11 is Gln or Glu
  MISC_FEATURE (12)..(12): Xaa at position 12 is Lys or Arg
  MISC_FEATURE (13)..(13): Xaa at position 13 is Met or Ile
  MISC_FEATURE (23)..(23): Xaa at position 23 is Gln or Glu
  MISC_FEATURE (25)..(25): Xaa at position 25 is Ala or Glu
  MISC_FEATURE (26)..(26): Xaa at position 26 is Asp or Ala
  MISC_FEATURE (28)..(28): Xaa at position 28 is Glu or Asp
  MISC_FEATURE (31)..(31): Xaa at position 31 is Lys, Gln or Arg
  MISC_FEATURE (32)..(32): Xaa at position 32 is Ala or Glu
  MISC_FEATURE (35)..(35): Xaa at position 35 is Glu or Asp
  MISC_FEATURE (36)..(36): Xaa at position 36 is Ala or Glu

SEQ ID NO: 135 - protein, 22 aa, Artificial Sequence
  PtIP-50 amino acid Motif
  MISC_FEATURE (5)..(5): Xaa at position 5 is Gln or Arg
  MISC_FEATURE (9)..(9): Xaa at position 9 is Asp or His
  MISC_FEATURE (16)..(16): Xaa at position 16 is Asn or Asp
  MISC_FEATURE (17)..(17): Xaa at position 17 is Arg or Gln
  MISC_FEATURE (18)..(18): Xaa at position 18 is Met or Leu
  MISC_FEATURE (19)..(19): Xaa at position 19 is Ala or Val
  MISC_FEATURE (20)..(20): Xaa at position 20 is Gln or Arg
LVVPXLQYXMYSNLIXXXXXVA

SEQ ID NO: 136 - protein, 31 aa, Artificial Sequence; identical to SEQ ID NO: 112
  PtIP-50 amino acid Motif
  MISC_FEATURE (1)..(1): Xaa at position 1 is Pro or Ala
  MISC_FEATURE (2)..(2): Xaa at position 2 is Asp or Val
  MISC_FEATURE (4)..(4): Xaa at position 4 is Leu or Val;
  MISC_FEATURE (9)..(9): Xaa at position 9 is Asn or Ser
  MISC_FEATURE (10)..(10): Xaa at position 10 is Ile or Val
  MISC_FEATURE (11)..(11): Xaa at position 11 is Leu or Ile
  MISC_FEATURE (12)..(12): Xaa at position 12 is Leu or Ser
  MISC_FEATURE (13)..(13): Xaa at position 13 is Gly or Cys
  MISC_FEATURE (17)..(17): Xaa at position 17 is Ser or Thr
  MISC_FEATURE (18)..(18): Xaa at position 18 is Met or Leu
  MISC_FEATURE (25)..(25): Xaa at position 25 is Glu or Leu
  MISC_FEATURE (26)..(26): Xaa at position 26 is Phe or Val
  MISC_FEATURE (27)..(27): Xaa at position 27 is Ala or Ser
  MISC_FEATURE (28)..(28): Xaa at position 28 is His or Gln
  MISC_FEATURE (29)..(29): Xaa at position 29 is Pro or Asn

SEQ ID NO: 137 - protein, 22 aa, Artificial Sequence
  PtIP-50 amino acid Motif
  MISC_FEATURE (1)..(1): Xaa at position 1 is Ala or Thr
  MISC_FEATURE (2)..(2): Xaa at position 2 is Thr or Val
  MISC_FEATURE (3)..(3): Xaa at position 3 is Ser or Gly
  MISC_FEATURE (5)..(5): Xaa at position 5 is Asp or Gly
  MISC_FEATURE (6)..(6): Xaa at position 6 is Ala or Asp
  MISC_FEATURE (15)..(15): Xaa at position 15 is His, Tyr or Phe
  MISC_FEATURE (16)..(16): Xaa at position 16 is Val or Ile
  MISC_FEATURE (17)..(17): Xaa at position 17 is Ser or Thr
  MISC_FEATURE (21)..(21): Xaa at position 21 is Arg, Gln or Glu
XXXAXXTTQIAITFXXXAIRXI

SEQ ID NO: 138 - protein, 22 aa, Artificial Sequence
  PtIP-50 amino acid Motif
  MISC_FEATURE (5)..(5): Xaa at position 5 is Asp or Glu
  MISC_FEATURE (20)..(20): Xaa at position 20 is Pro or Glu
  MISC_FEATURE (21)..(21): Xaa at position 21 is Ser or Gly
LEGAXKVKRLYVFADVVELXXK

SEQ ID NO: 139 - protein, 16 aa, Artificial Sequence
  PtIP-50 amino acid Motif
  MISC_FEATURE (2)..(2): Xaa at position 2 is Ile or Val
  MISC_FEATURE (5)..(5): Xaa at position 5 is Thr or Ser
  MISC_FEATURE (8)..(8): Xaa at position 8 is Val or Ile
  MISC_FEATURE (10)..(10): Xaa at position 10 is Ile or Met
  MISC_FEATURE (14)..(14): Xaa at position 14 is Ser or Gly
PXTDXGEXYXLLQXSR

SEQ ID NO: 140 - protein, 21 aa, Artificial Sequence
  PtIP-50 amino acid Motif
  MISC_FEATURE (2)..(2): Xaa at position 2 is Val or Leu
  MISC_FEATURE (3)..(3): Xaa at position 3 is Arg or Ser
  MISC_FEATURE (7)..(7): Xaa at position 7 is Ser or Thr
  MISC_FEATURE (8)..(8): Xaa at position 8 is Ile or Val
  MISC_FEATURE (9)..(9): Xaa at position 9 is Met or Ser
  MISC_FEATURE (16)..(16): Xaa at position 16 is Val or Ile
  MISC_FEATURE (18)..(18): Xaa at position 18 is His or Val
  MISC_FEATURE (19)..(19): Xaa at position 19 is Leu or Val
  MISC_FEATURE (21)..(21): Xaa at position 21 is Gly or Ser
TXXLPGXXXVVILCRXLXXNX

SEQ ID NO: 141 - protein, 22 aa, Artificial Sequence
  PtIP-50 amino acid Motif
  MISC_FEATURE (1)..(1): Xaa at position 1 is Ala or Val
  MISC_FEATURE (3)..(3): Xaa at position 3 is Thr or Arg
  MISC_FEATURE (4)..(4): Xaa at position 4 is Lys or Arg
  MISC_FEATURE (6)..(6): Xaa at position 6 is Val or Ala
  MISC_FEATURE (11)..(11): Xaa at position 11 is Lys or Thr
  MISC_FEATURE (14)..(14): Xaa at position 14 is Leu or Val
  MISC_FEATURE (16)..(16): Xaa at position 16 is Ala or Val
  MISC_FEATURE (22)..(22): Xaa at position 22 is Gly or Ser
XVXXHXEWLNXLLXQXSAAAQX

SEQ ID NO: 142 - protein, 16 aa, Artificial Sequence
  PtIP-50 amino acid Motif
  MISC_FEATURE (1)..(1): Xaa at position 1 is Tyr or Val
  MISC_FEATURE (2)..(2): Xaa at position 2 is Leu or Val
  MISC_FEATURE (6)..(6): Xaa at position 6 is Phe or Tyr
  MISC_FEATURE (8)..(8): Xaa at position 8 is Ala or Thr
  MISC_FEATURE (10)..(10): Xaa at position 10 is Tyr or Ala
  MISC_FEATURE (11)..(11): Xaa at position 11 is Leu, Val or Phe
  MISC_FEATURE (12)..(12): Xaa at position 12 is Ile or Leu
  MISC_FEATURE (14)..(14): Xaa at position 14 is Leu, Gly or Met
  MISC_FEATURE (16)..(16): Xaa at position 16 is Gly or Lys
XXALLXRXQXXXKXVX

SEQ ID NO: 143 - protein, 16 aa, Artificial Sequence
  PtIP-50 amino acid Motif
  MISC_FEATURE (3)..(3): Xaa at position 3 is Gly, Ala or Leu
  MISC_FEATURE (5)..(5): Xaa at position 5 is Val, Ile or Met
  MISC_FEATURE (6)..(6): Xaa at position 6 is Ala or Ser
  MISC_FEATURE (9)..(9): Xaa at position 9 is Lys, Gly or Arg
  MISC_FEATURE (10)..(10): Xaa at position 10 is Gly or Ala
  MISC_FEATURE (13)..(13): Xaa at position 13 is Ser or Thr
  MISC_FEATURE (14)..(14): Xaa at position 14 is Ala or Ile
APXAXXAAXXAVXXAG

SEQ ID NO: 144 - protein, 12 aa, Artificial Sequence
  PtIP-50 amino acid Motif
  MISC_FEATURE (1)..(1): Xaa at position 1 is Glu or Asp
  MISC_FEATURE (3)..(3): Xaa at position 3 is Trp or Tyr
  MISC_FEATURE (4)..(4): Xaa at position 4 is Glu or Gln
  MISC_FEATURE (7)..(7): Xaa at position 7 is Ile or Leu
XDXXFEXPVEDF

SEQ ID NO: 145 - protein, 12 aa, Artificial Sequence
  PtIP-50 amino acid Motif
  MISC_FEATURE (3)..(3): Xaa at position 3 is Glu or His
  MISC_FEATURE (7)..(7): Xaa at position 7 is Asp or Glu
  MISC_FEATURE (8)..(8): Xaa at position 8 is Leu or Val
  MISC_FEATURE (11)..(11): Xaa at position 11 is Val or Ile
YSXLYRXXNQXS

SEQ ID NO: 146 - protein, 9 aa, Artificial Sequence
  PtIP-50 amino acid Motif
  MISC_FEATURE (2)..(2): Xaa at position 2 is Ala or Ile
  MISC_FEATURE (3)..(3): Xaa at position 3 is Asn or Arg
FXXTFMRMT

SEQ ID NO: 147 - protein, 43 aa, Artificial Sequence
  PtIP-65 amino acid Motif
  MISC_FEATURE (13)..(13): Xaa at position 13 is Ser or Ala
  MISC_FEATURE (15)..(15): Xaa at position 15 is Trp, Ala or Gly
  MISC_FEATURE (17)..(17): Xaa at position 17 is Arg or Tyr
  MISC_FEATURE (19)..(19): Xaa at position 19 is Tyr, Glu or Arg
  MISC_FEATURE (21)..(21): Xaa at position 21 is Thr, Asn or Ser
  MISC_FEATURE (22)..(22): Xaa at position 22 is Thr or Gln
  MISC_FEATURE (23)..(23): Xaa at position 23 is Gly or Asn
  MISC_FEATURE (24)..(24): Xaa at position 24 is Gly or Arg
  MISC_FEATURE (25)..(25): Xaa at position 25 is Ser, Arg or Thr
  MISC_FEATURE (27)..(27): Xaa at position 27 is Phe or Asp
  MISC_FEATURE (28)..(28): Xaa at position 28 is Phe, Pro or His
  MISC_FEATURE (29)..(29): Xaa at position 29 is Gly or Lys
  MISC_FEATURE (31)..(31): Xaa at position 31 is Thr or Tyr
  MISC_FEATURE (35)..(35): Xaa at position 35 is Leu or Lys
  MISC_FEATURE (36)..(36): Xaa at position 36 is Lys or Gln
  MISC_FEATURE (41)..(41): Xaa at position 41 is Ile, Val or Gln
RLSLWGNGAGTRXGXIXFXTXXXXXFXXXMXSWGXXTEYPXDV

SEQ ID NO: 148 - protein, 31 aa, Artificial Sequence
  PtIP-65 amino acid Motif
  MISC_FEATURE (2)..(2): Xaa at position 2 is Ser, Thr or Arg
  MISC_FEATURE (4)..(4): Xaa at position 4 is Asp or Tyr
  MISC_FEATURE (5)..(5): Xaa at position 5 is Gly or Gln
  MISC_FEATURE (6)..(6): Xaa at position 6 is Gly, Ser or Glu
  MISC_FEATURE (7)..(7): Xaa at position 7 is Thr or Arg
  MISC_FEATURE (8)..(8): Xaa at position 8 is Asp or Asn
  MISC_FEATURE (10)..(10): Xaa at position 10 is Arg or Lys
  MISC_FEATURE (12)..(12): Xaa at position 12 is Leu or Met
  MISC_FEATURE (13)..(13): Xaa at position 13 is Gln, Thr or Arg
  MISC_FEATURE (14)..(14): Xaa at position 14 is Arg or Lys
  MISC_FEATURE (16)..(16): Xaa at position 16 is Gly or Arg
  MISC_FEATURE (18)..(18): Xaa at position 18 is Trp or Tyr
  MISC_FEATURE (19)..(19): Xaa at position 19 is Ala or Arg
  MISC_FEATURE (20)..(20): Xaa at position 20 is Gly or Ala
  MISC_FEATURE (21)..(21): Xaa at position 21 is Glu or Thr
  MISC_FEATURE (22)..(22): Xaa at position 22 is Ser or Trp
  MISC_FEATURE (23)..(23): Xaa at position 23 is Arg or Gln
  MISC_FEATURE (24)..(24): Xaa at position 24 is Ile or Leu
  MISC_FEATURE (25)..(25): Xaa at position 25 is Lys or Arg
  MISC_FEATURE (26)..(26): Xaa at position 26 is Ala or Gly
  MISC_FEATURE (28)..(28): Xaa at position 28 is Arg, Glu, or Ser
  MISC_FEATURE (31)..(31): Xaa at position 31 is Leu or Met
FXYXXXXXGXVXXXIXVXXXXXXXXXIXVWX

SEQ ID NO: 149 - protein, 31 aa, Artificial Sequence
  PtIP-65 amino acid Motif
  MISC_FEATURE (4)..(4): Xaa at position 4 is Asn or Ser
  MISC_FEATURE (5)..(5): Xaa at position 5 is Ser or Val
  MISC_FEATURE (7)..(7): Xaa at position 7 is Ile, Val and Leu
  MISC_FEATURE (8)..(8): Xaa at position 8 is Asp or Asn
  MISC_FEATURE (9)..(9): Xaa at position 9 is Ser or Ala
  MISC_FEATURE (12)..(12): Xaa at position 12 is Phe or Val
  MISC_FEATURE (13)..(13): Xaa at position 13 is Val, Met or Leu
  MISC_FEATURE (17)..(17): Xaa at position 17 is Pro, Thr or Ser
  MISC_FEATURE (19)..(19): Xaa at position 19 is Gln or Ala
  MISC_FEATURE (21)..(21): Xaa at position 21 is Ala, Val, Cys or Ser
  MISC_FEATURE (23)..(23): Xaa at position 23 is Leu or Met
  MISC_FEATURE (25)..(25): Xaa at position 25 is Asn or Ser
  MISC_FEATURE (27)..(27): Xaa at position 27 is Gln or Ser
GRAXXDXXXLGXXFLRXIXSXRXIXVXYPTL

SEQ ID NO: 150 - protein, 50 aa, Artificial Sequence
  PtIP-65 amino acid Motif
  MISC_FEATURE (2)..(2): Xaa at position 2 is Asn or Gly
  MISC_FEATURE (3)..(3): Xaa at position 3 is Gln or Val
  MISC_FEATURE (8)..(8): Xaa at position 8 is Glu or Ser
  MISC_FEATURE (9)..(9): Xaa at position 9 is Pro or Ala
  MISC_FEATURE (11)..(11): Xaa at position 11 is Gln or Glu
  MISC_FEATURE (12)..(12): Xaa at position 12 is Trp or Ser
  MISC_FEATURE (14)..(14): Xaa at position 14 is Ser or His
  MISC_FEATURE (15)..(15): Xaa at position 15 is Leu or Ile
  MISC_FEATURE (16)..(16): Xaa at position 16 is Gln or Lys
  MISC_FEATURE (18)..(18): Xaa at position 18 is Thr or Leu
  MISC_FEATURE (21)..(21): Xaa at position 21 is Arg or Lys
  MISC_FEATURE (23)..(23): Xaa at position 23 is Thr or Leu
  MISC_FEATURE (25)..(25): Xaa at position 25 is Thr or Ser
  MISC_FEATURE (26)..(26): Xaa at position 26 is Leu or Val
  MISC_FEATURE (28)..(28): Xaa at position 28 is Tyr or Phe
  MISC_FEATURE (30)..(30): Xaa at position 30 is Gly or Ala
  MISC_FEATURE (31)..(31): Xaa at position 31 is Thr or Ser
  MISC_FEATURE (32)..(32): Xaa at position 32 is Met or Ile
  MISC_FEATURE (33)..(33): Xaa at position 33 is Glu or Gln
  MISC_FEATURE (34)..(34): Xaa at position 34 is Ile or Val
  MISC_FEATURE (37)..(37): Xaa at position 37 is Gln, Lys or Leu
  MISC_FEATURE (38)..(38): Xaa at position 38 is Ser or Asn
  MISC_FEATURE (40)..(40): Xaa at position 40 is Thr or Asp
  MISC_FEATURE (41)..(41): Xaa at position 41 is Val or Ile
  MISC_FEATURE (43)..(43): Xaa at position 43 is Gln or Arg
  MISC_FEATURE (45)..(45): Xaa at position 45 is Pro or Ala
  MISC_FEATURE (46)..(46): Xaa at position 46 is Ile or Leu
  MISC_FEATURE (47)..(47): Xaa at position 47 is Ser or Lys
  MISC_FEATURE (48)..(48): Xaa at position 48 is Ser or Gly
  MISC_FEATURE (49)..(49): Xaa at position 49 is Met or Gln
WXXSGTLXXGXXIXXXAXTRXGXIXXPXQXXXXXTLXXGXXFXYXXXXXY

SEQ ID NO: 151 - protein, 30 aa, Artificial Sequence
  PtIP-65 amino acid Motif
  MISC_FEATURE (1)..(1): Xaa at position 1 is Gly or Gln
  MISC_FEATURE (2)..(2): Xaa at position 2 is Ile, Leu or Phe
  MISC_FEATURE (3)..(3): Xaa at position 3 is Glu, Ile or Thr
  MISC_FEATURE (4)..(4): Xaa at position 4 is Ala, Thr or Val
  MISC_FEATURE (5)..(5): Xaa at position 5 is His or Thr
  MISC_FEATURE (6)..(6): Xaa at position 6 is Ala or Ser
  MISC_FEATURE (8)..(8): Xaa at position 8 is Val or Ile
  MISC_FEATURE (9)..(9): Xaa at position 9 is Thr or Ser
  MISC_FEATURE (11)..(11): Xaa at position 11 is Gln, Glu or Ser
  MISC_FEATURE (13)..(13): Xaa at position 13 is Gly or Arg
  MISC_FEATURE (16)..(16): Xaa at position 16 is Ala or Ser
  MISC_FEATURE (17)..(17): Xaa at position 17 is Val or Leu
  MISC_FEATURE (21)..(21): Xaa at position 21 is Ser or Asn
  MISC_FEATURE (23)..(23): Xaa at position 23 is Glu or Val
  MISC_FEATURE (26)..(26): Xaa at position 26 is Phe or Val
  MISC_FEATURE (27)..(27): Xaa at position 27 is Ser, Glu or Gln
  MISC_FEATURE (29)..(29): Xaa at position 29 is Val or Ile
  MISC_FEATURE (30)..(30): Xaa at position 30 is Ser or Thr
XXXXXXSXXVXAXIPXXAEVXGXGWXXSXX

SEQ ID NO: 152 - protein, 16 aa, Artificial Sequence
  PtIP-65 amino acid Motif
  MISC_FEATURE (2)..(2): Xaa at position 2 is Gly or Leu
  MISC_FEATURE (3)..(3): Xaa at position 3 is Ser or Glu
  MISC_FEATURE (7)..(7): Xaa at position 7 is Phe or Tyr
  MISC_FEATURE (11)..(11): Xaa at position 11 is Asp, Glu or Thr
RXXYSEXTFAXGERIT

SEQ ID NO: 153 - protein, 30 aa, Artificial Sequence
  PtIP-65 amino acid Motif
  MISC_FEATURE (1)..(1): Xaa at position 1 is Asn or Thr
  MISC_FEATURE (3)..(3): Xaa at position 3 is Ser or Lys
  MISC_FEATURE (6)..(6): Xaa at position 6 is Ala or Asp
  MISC_FEATURE (7)..(7): Xaa at position 7 is Gly, Asp or Ser
  MISC_FEATURE (9)..(9): Xaa at position 9 is Ile or Glu
  MISC_FEATURE (10)..(10): Xaa at position 10 is Pro or Ser
  MISC_FEATURE (11)..(11): Xaa at position 11 is Lys or Leu
  MISC_FEATURE (14)..(14): Xaa at position 14 is Thr or Val
  MISC_FEATURE (15)..(15): Xaa at position 15 is Phe or Leu
  MISC_FEATURE (16)..(16): Xaa at position 16 is Ser or Ala
  MISC_FEATURE (20)..(20): Xaa at position 20 is Thr or Gln
  MISC_FEATURE (23)..(23): Xaa at position 23 is Ile, Thr or Val
  MISC_FEATURE (26)..(26): Xaa at position 26 is Ser or Thr
  MISC_FEATURE (28)..(28): Xaa at position 28 is Ser, Thr or Arg
  MISC_FEATURE (29)..(29): Xaa at position 29 is Leu or Thr
XDXNNXXSXXXNWXXXGSRXVTXSSXWXXT

SEQ ID NO: 154 - protein, 22 aa, Artificial Sequence
  PtIP-65 amino acid Motif
  MISC_FEATURE (1)..(1): Xaa at position 1 is Gln or Gly
  MISC_FEATURE (2)..(2): Xaa at position 2 is Glu or Val
  MISC_FEATURE (3)..(3): Xaa at position 3 is Gly or Lys
  MISC_FEATURE (5)..(5): Xaa at position 5 is His or Gln
  MISC_FEATURE (6)..(6): Xaa at position 6 is Asn or Ser
  MISC_FEATURE (10)..(10): Xaa at position 10 is Asn or Asp
  MISC_FEATURE (13)..(13): Xaa at position 13 is Val or Ala
  MISC_FEATURE (14)..(14): Xaa at position 14 is Glu, Gln or Lys
  MISC_FEATURE (16)..(16): Xaa at position 16 is Cys, Arg or Ser
  MISC_FEATURE (17)..(17): Xaa at position 17 is Lys or Thr
  MISC_FEATURE (18)..(18): Xaa at position 18 is Leu or Val
  MISC_FEATURE (21)..(21): Xaa at position 21 is Ala, Ile or Thr
XXXDXXVQPXKEXXEXXXLFXE

SEQ ID NO: 155 - protein, 36 aa, Artificial Sequence
  PtIP-65 amino acid Motif
  MISC_FEATURE (1)..(1): Xaa at position 1 is Ile, Met or Val
  MISC_FEATURE (2)..(2): Xaa at position 2 is Gln or Glu
  MISC_FEATURE (4)..(4): Xaa at position 4 is Ser or Thr
  MISC_FEATURE (6)..(6): Xaa at position 6 is Ala or Ser
  MISC_FEATURE (7)..(7): Xaa at position 7 is Asn or Asp
  MISC_FEATURE (9)..(9): Xaa at position 9 is Thr or Ile
  MISC_FEATURE (11)..(11): Xaa at position 11 is Ser, Arg or Thr
  MISC_FEATURE (13)..(13): Xaa at position 13 is Asn, Ala or Asp
  MISC_FEATURE (14)..(14): Xaa at position 14 is Glu or Ala
  MISC_FEATURE (19)..(19): Xaa at position 19 is Cys or Gly
  MISC_FEATURE (21)..(21): Xaa at position 21 is Ile or Val
  MISC_FEATURE (25)..(25): Xaa at position 25 is Leu, Val or Ile
  MISC_FEATURE (30)..(30): Xaa at position 30 is Ser or Leu
  MISC_FEATURE (31)..(31): Xaa at position 31 is Leu or Ile
  MISC_FEATURE (32)..(32): Xaa at position 32 is Pro or Ile
  MISC_FEATURE (33)..(33): Xaa at position 33 is Lys or Ser
  MISC_FEATURE (33)..(33): Xaa at position 33 is Lys or Ser
  MISC_FEATURE (34)..(34): Xaa at position 34 is His or Arg
  MISC_FEATURE (35)..(35): Xaa at position 35 is Arg, Ala, Ser or Val
XXGXIXXLXVXTXXYSVWXHXSDTXAPAQXXXXXXA

SEQ ID NO: 156 - protein, 42 aa, Artificial Sequence
  PtIP-65 amino acid Motif
  MISC_FEATURE (1)..(1): Xaa at position 1 is Trp, Pro or Tyr
  MISC_FEATURE (2)..(2): Xaa at position 2 is Asp, Thr or Asn
  MISC_FEATURE (3)..(3): Xaa at position 3 is His, Asn or Val
  MISC_FEATURE (4)..(4): Xaa at position 4 is Val or Ile
  MISC_FEATURE (5)..(5): Xaa at position 5 is Ala or Gly
  MISC_FEATURE (7)..(7): Xaa at position 7 is Val or Ile
  MISC_FEATURE (8)..(8): Xaa at position 8 is Arg or Trp
  MISC_FEATURE (10)..(10): Xaa at position 10 is Ser or Gln
  MISC_FEATURE (13)..(13): Xaa at position 13 is Arg or Leu
  MISC_FEATURE (14)..(14): Xaa at position 14 is Gly or Leu
  MISC_FEATURE (16)..(16): Xaa at position 16 is Thr or Ile
  MISC_FEATURE (19)..(19): Xaa at position 19 is Tyr or Phe
  MISC_FEATURE (21)..(21): Xaa at position 21 is Ser or Met
  MISC_FEATURE (22)..(22): Xaa at position 22 is Ser or Thr
  MISC_FEATURE (23)..(23): Xaa at position 23 is Arg or Val
  MISC_FEATURE (24)..(24): Xaa at position 24 is Glu or Gln
  MISC_FEATURE (26)..(26): Xaa at position 26 is Ser or Thr
  MISC_FEATURE (28)..(28): Xaa at position 28 is Gln, Lys or Arg
  MISC_FEATURE (29)..(29): Xaa at position 29 is Trp or Val
  MISC_FEATURE (30)..(30): Xaa at position 30 is Phe, Ile or Thr
  MISC_FEATURE (31)..(31): Xaa at position 31 is Thr or Glu
  MISC_FEATURE (32)..(32): Xaa at position 32 is Val or Ala
  MISC_FEATURE (42)..(42): Xaa at position 42 is Val or Met
XXXXXRXXFXTSXXRXFEXGXXXXPXGXXXXXNVGSGVCVGX

SEQ ID NO: 157 - protein, 41 aa, Artificial Sequence
  PtIP-65 amino acid Motif
  MISC_FEATURE (2)..(2): Xaa at position 2 is Ser or Thr
  MISC_FEATURE (4)..(4): Xaa at position 4 is Asn or Thr
  MISC_FEATURE (6)..(6): Xaa at position 6 is Gln, Gly or Leu
  MISC_FEATURE (8)..(8): Xaa at position 8 is Thr or Ala
  MISC_FEATURE (10)..(10): Xaa at position 10 is Asp, His or Asn
  MISC_FEATURE (11)..(11): Xaa at position 11 is Gln or His
  MISC_FEATURE (12)..(12): Xaa at position 12 is Asp or Glu
  MISC_FEATURE (14)..(14): Xaa at position 14 is Pro or Gln
  MISC_FEATURE (18)..(18): Xaa at position 18 is Glu or Gln
  MISC_FEATURE (19)..(19): Xaa at position 19 is Gln or Lys
  MISC_FEATURE (23)..(23): Xaa at position 23 is Glu or Gln
  MISC_FEATURE (29)..(29): Xaa at position 29 is Ser or Arg
  MISC_FEATURE (34)..(34): Xaa at position 34 is Ser or Phe
  MISC_FEATURE (35)..(35): Xaa at position 35 is His or Leu
  MISC_FEATURE (36)..(36): Xaa at position 36 is Ser or Thr
  MISC_FEATURE (38)..(38): Xaa at position 38 is Ser or Ile
KXFXLXNXAXXXDXSSTXXLAWXLADEPXFDNVXXXWXLSN

SEQ ID NO: 158 - protein, 16 aa, Artificial Sequence
  PtIP-65 amino acid Motif
  MISC_FEATURE (1)..(1): Xaa at position 1 is Leu or Met
  MISC_FEATURE (2)..(2): Xaa at position 2 is Ala, Val or Tyr
  MISC_FEATURE (3)..(3): Xaa at position 3 is Gln or Leu
  MISC_FEATURE (4)..(4): Xaa at position 4 is Thr or Val
  MISC_FEATURE (5)..(5): Xaa at position 5 is Pro or Ile
  MISC_FEATURE (6)..(6): Xaa at position 6 is Val or Gly
  MISC_FEATURE (7)..(7): Xaa at position 7 is Tyr or Thr
  MISC_FEATURE (8)..(8): Xaa at position 8 is Val or Leu
  MISC_FEATURE (15)..(15): Xaa at position 15 is Ser or Asn
  MISC_FEATURE (16)..(16): Xaa at position 16 is Ala, Gln or Ser
XXXXXXXXIGGQGGXX

SEQ ID NO: 159 - protein, 16 aa, Artificial Sequence
  PtIP-65 amino acid Motif
  MISC_FEATURE (10)..(10): Xaa at position 10 is Thr or Val
  MISC_FEATURE (11)..(11): Xaa at position 11 is Asn or Ser
  MISC_FEATURE (12)..(12): Xaa at position 12 is Thr or Gln
  MISC_FEATURE (16)..(16): Xaa at position 16 is Ala or Asp
GVDYTSVDIXXXGTRX

SEQ ID NO: 160 - protein, 50 aa, Artificial Sequence
  PtIP-65 amino acid Motif
  MISC_FEATURE (1)..(1): Xaa at position 1 is Leu or Trp
  MISC_FEATURE (2)..(2): Xaa at position 2 is Val or Ile
  MISC_FEATURE (6)..(6): Xaa at position 6 is Arg or Ser
  MISC_FEATURE (8)..(8): Xaa at position 8 is Thr or Asp
  MISC_FEATURE (9)..(9): Xaa at position 9 is Ala or Asn
  MISC_FEATURE (11)..(11): Xaa at position 11 is Pro or Gln
  MISC_FEATURE (15)..(15): Xaa at position 15 is Asn or Arg
  MISC_FEATURE (19)..(19): Xaa at position 19 is Phe, Ile or Leu
  MISC_FEATURE (21)..(21): Xaa at position 21 is Ser or Asp
  MISC_FEATURE (22)..(22): Xaa at position 22 is Gly, Ala or Ser
  MISC_FEATURE (23)..(23): Xaa at position 23 is Gly, Ala or Asp
  MISC_FEATURE (24)..(24): Xaa at position 24 is Asn, Gly or Tyr
  MISC_FEATURE (25)..(25): Xaa at position 25 is Asn, Asp or Gly
  MISC_FEATURE (26)..(26): Xaa at position 26 is Leu or Phe
  MISC_FEATURE (29)..(29): Xaa at position 29 is Ala or Gly
  MISC_FEATURE (30)..(30): Xaa at position 30 is Thr or Ser
  MISC_FEATURE (32)..(32): Xaa at position 32 is Ser or Thr
  MISC_FEATURE (36)..(36): Xaa at position 36 is Arg, Gly or Gln
  MISC_FEATURE (37)..(37): Xaa at position 37 is Leu, Ser or Val
  MISC_FEATURE (38)..(38): Xaa at position 38 is Leu or Phe
  MISC_FEATURE (40)..(40): Xaa at position 40 is Asp, Asn or Ser
  MISC_FEATURE (41)..(41): Xaa at position 40 is Asp, Asn or Ser
  MISC_FEATURE (42)..(42): Xaa at position 42 is Gly or Arg
  MISC_FEATURE (46)..(46): Xaa at position 46 is Asp, Asn, Gln or Thr
  MISC_FEATURE (49)..(49): Xaa at position 49 is Val or Ile
  MISC_FEATURE (50)..(50): Xaa at position 50 is Leu or Ile
XXGEGXIXXLXCSAXIQVXTXXXXXXPFXXFXFPVXXXYXXXAHSXVQXX

SEQ ID NO: 161 - protein, 12 aa, Artificial Sequence
  PtIP-65 amino acid Motif
  MISC_FEATURE (1)..(1): Xaa at position 1 is Leu or Phe
  MISC_FEATURE (2)..(2): Xaa at position 2 is Glu or Asp
  MISC_FEATURE (3)..(3): Xaa at position 3 is Gln or Thr
  MISC_FEATURE (4)..(4): Xaa at position 4 is Ala or Gln
  MISC_FEATURE (7)..(7): Xaa at position 7 is Ile, Val, Ser or Thr
  MISC_FEATURE (9)..(9): Xaa at position 9 is Val, Ile, Thr or Gln
  MISC_FEATURE (10)..(10): Xaa at position 10 is Thr or Ala
  MISC_FEATURE (12)..(12): Xaa at position 12 is Asp or Lys
XXXXGIXPXXLX

SEQ ID NO: 162 - protein, 9 aa, Artificial Sequence
  PtIP-65 amino acid Motif
  MISC_FEATURE (1)..(1): Xaa at position 1 is Ala, Val or Ser
  MISC_FEATURE (4)..(4): Xaa at position 4 is Ile, Leu or Val
  MISC_FEATURE (5)..(5): Xaa at position 5 is Cys or Trp
  MISC_FEATURE (6)..(6): Xaa at position 6 is Val or Ala
  MISC_FEATURE (8)..(8): Xaa at position 8 is Ile, Val, Leu or Phe
  MISC_FEATURE (9)..(9): Xaa at position 9 is Thr, Ile, Leu, Met or Arg
XSGXXXGXX

SEQ ID NO: 163 - protein, 16 aa, Artificial Sequence
  PtIP-65 amino acid Motif
  MISC_FEATURE (2)..(2): Xaa at position 2 is Gly or Glu
  MISC_FEATURE (3)..(3): Xaa at position 3 is Val or Ala
  MISC_FEATURE (4)..(4): Xaa at position 4 is Gln, Glu or Ala
  MISC_FEATURE (5)..(5): Xaa at position 5 is Lys, Gln or Arg
  MISC_FEATURE (6)..(6): Xaa at position 6 is Thr or Leu
  MISC_FEATURE (11)..(11): Xaa at position 11 is Ser or His
  MISC_FEATURE (12)..(12): Xaa at position 12 is Arg or Asp
  MISC_FEATURE (14)..(14): Xaa at position 14 is Ala, Pro or Ser
DXXXXXFGDPXXPXGE

SEQ ID NO: 164 - protein, 22 aa, Artificial Sequence
  PtIP-65 amino acid Motif
  MISC_FEATURE (2)..(2): Xaa at position 2 is Thr, Leu or Pro
  MISC_FEATURE (3)..(3): Xaa at position 3 is Ala or Glu
  MISC_FEATURE (8)..(8): Xaa at position 8 is Asn, Thr or Ala
  MISC_FEATURE (10)..(10): Xaa at position 10 is Gly, Gln or His
  MISC_FEATURE (12)..(12): Xaa at position 12 is Glu or Gln
  MISC_FEATURE (14)..(14): Xaa at position 14 is Val or Ala
  MISC_FEATURE (16)..(16): Xaa at position 16 is Thr or Ala
  MISC_FEATURE (20)..(20): Xaa at position 20 is Thr, Ile or Ser
GXXGASTXFXWXTXRXFPSXNA

SEQ ID NO: 165 - protein, 12 aa, Artificial Sequence
  PtIP-65 amino acid Motif
  MISC_FEATURE (1)..(1): Xaa at position 1 is Thr or Ser
  MISC_FEATURE (3)..(3): Xaa at position 3 is Asp, Ser, Thr or Asn
  MISC_FEATURE (4)..(4): Xaa at position 4 is Asp or Ser
  MISC_FEATURE (5)..(5): Xaa at position 5 is Thr, Ser or Asn
  MISC_FEATURE (7)..(7): Xaa at position 7 is Ala, His, Tyr, Arg, Ile or Thr
  MISC_FEATURE (8)..(8): Xaa at position 8 is Thr, Val or Leu
  MISC_FEATURE (9)..(9): Xaa at position 9 is Phe, Tyr or Cys
  MISC_FEATURE (11)..(11): Xaa at position 11 is Thr or Ser
  MISC_FEATURE (12)..(12): Xaa at position 12 is Ala, Pro or Val
XGXXXPXXXGXX

SEQ ID NO: 166 - protein, 29 aa, Artificial Sequence
  PtIP-65 amino acid Motif
  MISC_FEATURE (3)..(3): Xaa at position 3 is Gln or Glu
  MISC_FEATURE (14)..(14): Xaa at position 14 is Leu or Ser
  MISC_FEATURE (20)..(20): Xaa at position 20 is Asn or Ser
  MISC_FEATURE (27)..(27): Xaa at position 27 is Glu, Lys or Gln
  MISC_FEATURE (29)..(29): Xaa at position 29 is Leu or Phe
DTXSSSLSSSSSLXLPWSRXGSLLPSXSX

SEQ ID NO: 167 - protein, 22 aa, Artificial Sequence
  PtIP-65 amino acid Motif
  MISC_FEATURE (3)..(3): Xaa at position 3 is Thr or Val
  MISC_FEATURE (4)..(4): Xaa at position 4 is Gly or Ala
  MISC_FEATURE (5)..(5): Xaa at position 5 is Asn, Arg or Ser
  MISC_FEATURE (6)..(6): Xaa at position 6 is Ala, Asn or Asp
  MISC_FEATURE (8)..(8): Xaa at position 8 is Ser, Thr or Leu
  MISC_FEATURE (9)..(9): Xaa at position 9 is Ile, Val or Leu
  MISC_FEATURE (10)..(10): Xaa at position 10 is Asn or Asp
  MISC_FEATURE (11)..(11): Xaa at position 11 is Val, Ile Leu or Met
  MISC_FEATURE (12)..(12): Xaa at position 12 is Asp, Thr or Ser
  MISC_FEATURE (16)..(16): Xaa at position 16 is Asn or Asp
  MISC_FEATURE (17)..(17): Xaa at position 17 is Thr or Ala
  MISC_FEATURE (19)..(19): Xaa at position 19 is Thr or Lys
  MISC_FEATURE (20)..(20): Xaa at position 20 is Val or Ile
  MISC_FEATURE (22)..(22): Xaa at position 22 is Pro or Ala
HLXXXXIXXXXXLGIXXPXXVX

SEQ ID NO: 168 - protein, 12 aa, Artificial Sequence
  PtIP-65 amino acid Motif
  MISC_FEATURE (1)..(1): Xaa at position 1 is Lys, Leu or Ser
  MISC_FEATURE (2)..(2): Xaa at position 2 is Asp, Lys or Asn
  MISC_FEATURE (3)..(3): Xaa at position 3 is Glu, His or Gln
  MISC_FEATURE (7)..(7): Xaa at position 7 is Glu or Gln
  MISC_FEATURE (9)..(9): Xaa at position 9 is Thr or Val
  MISC_FEATURE (10)..(10): Xaa at position 10 is Asp or Glu
XXXVEVXAXXQQ

SEQ ID NO: 169 - protein, 12 aa, Artificial Sequence
  PtIP-65 amino acid Motif
  MISC_FEATURE (2)..(2): Xaa at position 2 is Thr or Ala
  MISC_FEATURE (3)..(3): Xaa at position 3 is Ser or Thr
YXXTQEESRTLT

SEQ ID NO: 170 - protein, 31 aa, Artificial Sequence
  PtIP-65 amino acid Motif
  MISC_FEATURE (1)..(1): Xaa at position 1 is Ala or Gln
  MISC_FEATURE (2)..(2): Xaa at position 2 is Arg or Val
  MISC_FEATURE (3)..(3): Xaa at position 3 is Val or Thr
  MISC_FEATURE (6)..(6): Xaa at position 6 is Ser or Thr
  MISC_FEATURE (7)..(7): Xaa at position 7 is Gly or His
  MISC_FEATURE (8)..(8): Xaa at position 8 is Gly or Ser
  MISC_FEATURE (9)..(9): Xaa at position 9 is Thr or Arg
  MISC_FEATURE (13)..(13): Xaa at position 13 is Ser or Pro
  MISC_FEATURE (16)..(16): Xaa at position 16 is Gln, His or Lys
  MISC_FEATURE (18)..(18): Xaa at position 18 is Ala, Phe, Leu or Arg
  MISC_FEATURE (19)..(19): Xaa at position 19 is Phe or Tyr
  MISC_FEATURE (22)..(22): Xaa at position 22 is Gln or Glu
  MISC_FEATURE (24)..(24): Xaa at position 24 is His or Tyr
  MISC_FEATURE (25)..(25): Xaa at position 25 is Val or Ala
  MISC_FEATURE (26)..(26): Xaa at position 26 is Ile or Pro
  MISC_FEATURE (27)..(27): Xaa at position 27 is Ala or Asp
  MISC_FEATURE (28)..(28): Xaa at position 28 is Ile or Val
  MISC_FEATURE (30)..(30): Xaa at position 30 is Thr, Ala or Ser
XXXTTXXXXFSFXGLXGXXTGXSXXXXXTXQ

SEQ ID NO: 171 - protein, 16 aa, Artificial Sequence
  PtIP-65 amino acid Motif
  MISC_FEATURE (2)..(2): Xaa at position 2 is Ser or Val
  MISC_FEATURE (5)..(5): Xaa at position 5 is Pro or Thr
  MISC_FEATURE (6)..(6): Xaa at position 6 is Tyr, Phe or Arg
  MISC_FEATURE (7)..(7): Xaa at position 7 is Arg, Asp, Gly or Gln
  MISC_FEATURE (9)..(9): Xaa at position 9 is Asn, Asp, Ile or Thr
  MISC_FEATURE (10)..(10): Xaa at position 10 is Val, Ala or Leu
  MISC_FEATURE (11)..(11): Xaa at position 10 is Val, Ala or Leu
  MISC_FEATURE (12)..(12): Xaa at position 12 is Gly, Asp or Asn
  MISC_FEATURE (14)..(14): Xaa at position 14 is Pro, Phe, Arg or Ser
  MISC_FEATURE (16)..(16): Xaa at position 16 is Asn, Asp, Glu or Thr
LXALXXXGXXXXLXFX

SEQ ID NO: 172 - protein, 9 aa, Artificial Sequence
  PtIP-65 amino acid Motif
  MISC_FEATURE (2)..(2): Xaa at position 2 is Thr, Phe, Pro or Ser
  MISC_FEATURE (5)..(5): Xaa at position 5 is Glu, Gln or Ser
  MISC_FEATURE (6)..(6): Xaa at position 6 is Glu, Gln or His
  MISC_FEATURE (9)..(9): Xaa at position 9 is Asp or Ala
TXILXXLPX

SEQ ID NO: 173 - protein, 43 aa, Artificial Sequence; identical to SEQ ID NO: 147
  PtIP-65 amino acid Motif
  MISC_FEATURE (13)..(131): Xaa at position 13 is Ser, Thr or Ala
  MISC_FEATURE (15)..(15): Xaa at position 15 is Trp, Ala, Tyr, Phe or Gly
  MISC_FEATURE (17)..(17): Xaa at position 17 is Arg, Lys, Trp, Phe or Tyr
  MISC_FEATURE (19)..(19): Xaa at position 19 is Tyr, Glu, Asp, Lys, Trp, Phe or Arg
  MISC_FEATURE (21)..(21): Xaa at position 21 is Thr, Asn, Gln or Ser
  MISC_FEATURE (22)..(22): Xaa at position 22 is Thr, Asn, Ser or Gln
  MISC_FEATURE (23)..(23): Xaa at position 23 is Gly, Gln or Asn
  MISC_FEATURE (24)..(24): Xaa at position 24 is Gly, Lys or Arg
  MISC_FEATURE (25)..(25): Xaa at position 25 is Ser, Arg, Lys or Thr
  MISC_FEATURE (27)..(27): Xaa at position 27 is Phe, Glu or Asp
  MISC_FEATURE (28)..(28): Xaa at position 28 is Phe, Pro or His
  MISC_FEATURE (29)..(29): Xaa at position 29 is Gly, Arg or Lys
  MISC_FEATURE (31)..(31): Xaa at position 31 is Thr, Ser, Trp, Phe or Tyr
  MISC_FEATURE (35)..(35): Xaa at position 35 is Leu, Arg, Ile, Val or Lys
  MISC_FEATURE (36)..(36): Xaa at position 36 is Lys, Arg, Asn or Gln
  MISC_FEATURE (41)..(41): Xaa at position 41 is Ile, Val, Leu, Asn or Gln

SEQ ID NO: 174 - protein, 31 aa, Artificial Sequence; identical to SEQ ID NO: 148
  PtIP-65 amino acid Motif
  MISC_FEATURE (2)..(2): Xaa at position 2 is Ser, Thr, Lys or Arg
  MISC_FEATURE (4)..(4): Xaa at position 4 is Asp, Glu, Trp, Phe or Tyr
  MISC_FEATURE (5)..(5): Xaa at position 5 is Gly, Asn or Gln
  MISC_FEATURE (6)..(6): Xaa at position 6 is Gly, Ser, Thr, Asp or Glu
  MISC_FEATURE (7)..(7): Xaa at position 7 is Thr, Lys, Ser or Arg
  MISC_FEATURE (8)..(8): Xaa at position 8 is Asp, Glu, Gln or Asn
  MISC_FEATURE (10)..(10): Xaa at position 10 is Arg or Lys
  MISC_FEATURE (12)..(12): Xaa at position 12 is Leu, Ile, Val or Met
  MISC_FEATURE (13)..(13): Xaa at position 13 is Gln, Thr, Asn, Ser, Lys or Arg
  MISC_FEATURE (14)..(14): Xaa at position 14 is Arg or Lys
  MISC_FEATURE (16)..(16): Xaa at position 16 is Gly, Lys or Arg
  MISC_FEATURE (18)..(18): Xaa at position 18 is Trp or Tyr
  MISC_FEATURE (19)..(19): Xaa at position 19 is Ala, Lys or Arg
  MISC_FEATURE (20)..(20): Xaa at position 20 is Gly or Ala
  MISC_FEATURE (21)..(21): Xaa at position 21 is Glu, Asp, Ser or Thr
  MISC_FEATURE (22)..(22): Xaa at position 22 is Ser, Thr, Tyr, Phe or Trp
  MISC_FEATURE (23)..(23): Xaa at position 23 is Arg, Lys, Asn or Gln
  MISC_FEATURE (24)..(24): Xaa at position 24 is Ile, Val or Leu
  MISC_FEATURE (25)..(25): Xaa at position 25 is Lys or Arg
  MISC_FEATURE (26)..(26): Xaa at position 26 is Ala or Gly
  MISC_FEATURE (28)..(28): Xaa at position 28 is Arg, Glu, Ser, Lys, Asp or Thr
  MISC_FEATURE (31)..(31): Xaa at position 31 is Leu, Ile, Val or Met

SEQ ID NO: 175 - protein, 31 aa, Artificial Sequence; identical to SEQ ID NO: 149
  PtIP-65 amino acid Motif
  MISC_FEATURE (4)..(4): Xaa at position 4 is Asn, Gln, Thr or Ser
  MISC_FEATURE (5)..(5): Xaa at position 5 is Ser, Thr, Ile, Leu or Val
  MISC_FEATURE (7)..(7): Xaa at position 7 is Ile, Val and Leu
  MISC_FEATURE (8)..(8): Xaa at position 8 is Asp, Gln, Glu or Asn
  MISC_FEATURE (9)..(9): Xaa at position 9 is Ser, Thr or Ala
  MISC_FEATURE (12)..(12): Xaa at position 12 is Phe, Ile, Leu or Val
  MISC_FEATURE (13)..(13): Xaa at position 13 is Val, Met, Ile or Leu
  MISC_FEATURE (17)..(17): Xaa at position 17 is Pro, Thr or Ser
  MISC_FEATURE (19)..(19): Xaa at position 19 is Gln, Asn or Ala
  MISC_FEATURE (21)..(21): Xaa at position 21 is Ala, Val, Cys, Ile, Leu, Thr or Ser
  MISC_FEATURE (23)..(23): Xaa at position 23 is Leu, Ile, Val or Met
  MISC_FEATURE (25)..(25): Xaa at position 25 is Asn, Gln, Thr or Ser
  MISC_FEATURE (27)..(27): Xaa at position 27 is Gln, Asn, Thr or Ser

SEQ ID NO: 176 - protein, 50 aa, Artificial Sequence; identical to SEQ ID NO: 150
  PtIP-65 amino acid Motif
  MISC_FEATURE (2)..(2): Xaa at position 2 is Asn, Gln or Gly
  MISC_FEATURE (3)..(3): Xaa at position 3 is Gln, Asn, Ile, Leu or Val
  MISC_FEATURE (8)..(8): Xaa at position 8 is Glu, Asp, Thr or Ser
  MISC_FEATURE (9)..(9): Xaa at position 9 is Pro or Ala
  MISC_FEATURE (11)..(11): Xaa at position 11 is Gln, Asn, Asp or Glu
  MISC_FEATURE (12)..(12): Xaa at position 12 is Trp, Tyr, Thr or Ser
  MISC_FEATURE (14)..(14): Xaa at position 14 is Ser, Thr or His
  MISC_FEATURE (15)..(15): Xaa at position 15 is Leu, Val or Ile
  MISC_FEATURE (16)..(16): Xaa at position 16 is Gln, Asn, Arg or Lys
  MISC_FEATURE (18)..(18): Xaa at position 18 is Thr, Ser, Ile, Val or Leu
  MISC_FEATURE (21)..(21): Xaa at position 21 is Arg or Lys
  MISC_FEATURE (23)..(23): Xaa at position 23 is Thr, Ser, Ile, Val or Leu
  MISC_FEATURE (25)..(25): Xaa at position 25 is Thr or Ser
  MISC_FEATURE (26)..(26): Xaa at position 26 is Leu, Ile or Val
  MISC_FEATURE (28)..(28): Xaa at position 28 is Tyr, Trp or Phe
  MISC_FEATURE (30)..(30): Xaa at position 30 is Gly or Ala
  MISC_FEATURE (31)..(31): Xaa at position 31 is Thr or Ser
  MISC_FEATURE (32)..(32): Xaa at position 32 is Met, Leu, Val or Ile
  MISC_FEATURE (33)..(33): Xaa at position 33 is Glu, Asp, Asn or Gln
  MISC_FEATURE (34)..(34): Xaa at position 34 is Ile, Leu or Val
  MISC_FEATURE (37)..(37): Xaa at position 37 is Gln, Lys, Asn, Arg, Ile, Val or Leu
  MISC_FEATURE (38)..(38): Xaa at position 38 is Ser, Thr, Gln or Asn
  MISC_FEATURE (40)..(40): Xaa at position 40 is Thr, Ser, Glu or Asp
  MISC_FEATURE (41)..(41): Xaa at position 41 is Val, Leu or Ile
  MISC_FEATURE (43)..(43): Xaa at position 43 is Gln, Asn, Lys or Arg
  MISC_FEATURE (45)..(45): Xaa at position 45 is Pro or Ala
  MISC_FEATURE (46)..(46): Xaa at position 46 is Ile, Val or Leu
  MISC_FEATURE (47)..(47): Xaa at position 47 is Ser, Thr, Arg or Lys
  MISC_FEATURE (48)..(48): Xaa at position 48 is Ser, Thr or Gly
  MISC_FEATURE (49)..(49): Xaa at position 49 is Met, Asn or Gln

SEQ ID NO: 177 - protein, 30 aa, Artificial Sequence; identical to SEQ ID NO: 151
  PtIP-65 amino acid Motif
  MISC_FEATURE (1)..(1): Xaa at position 1 is Gly, Asn or Gln
  MISC_FEATURE (2)..(2): Xaa at position 2 is Ile, Leu, Val or Phe
  MISC_FEATURE (3)..(3): Xaa at position 3 is Glu, Ile, Asp, Leu, Val, Ser or Thr
  MISC_FEATURE (4)..(4): Xaa at position 4 is Ala, Thr, Ser, Ile, Leu or Val
  MISC_FEATURE (5)..(5): Xaa at position 5 is His, Ser or Thr
  MISC_FEATURE (6)..(6): Xaa at position 6 is Ala, Thr or Ser
  MISC_FEATURE (8)..(8): Xaa at position 8 is Val, Leu or Ile
  MISC_FEATURE (9)..(9): Xaa at position 9 is Thr or Ser
  MISC_FEATURE (11)..(11): Xaa at position 11 is Gln, Glu, Asn Asp, Thr or Ser
  MISC_FEATURE (13)..(13): Xaa at position 13 is Gly, Lys or Arg
  MISC_FEATURE (16)..(16): Xaa at position 16 is Ala, Thr or Ser
  MISC_FEATURE (17)..(17): Xaa at position 17 is Val, Leu ot Ile
  MISC_FEATURE (21)..(21): Xaa at position 21 is Ser, Thr, Gln or Asn
  MISC_FEATURE (23)..(23): Xaa at position 23 is Glu, Asp, Ile, Leu or Val
  MISC_FEATURE (24)..(24): Xaa at position 24 is Phe, Ile, Leu or Val
  MISC_FEATURE (26)..(26): Xaa at position 26 is Ser, Glu, Thr, Asp, Asn or Gln
  MISC_FEATURE (27)..(27): Xaa at position 27 is Val, Leu or Ile
  MISC_FEATURE (29)..(29): Xaa at position 29 is Val, Ile, Leu or Ala
  MISC_FEATURE (30)..(30): Xaa at position 30 is Ser or Thr

SEQ ID NO: 178 - protein, 16 aa, Artificial Sequence
  PtIP-65 amino acid Motif
  MISC_FEATURE (2)..(2): Xaa at position 2 is Gly, Ile, Val or Leu
  MISC_FEATURE (3)..(3): Xaa at position 3 is Ser, Thr, Asp or Glu
  MISC_FEATURE (7)..(7): Xaa at position 7 is Phe, Trp or Tyr
  MISC_FEATURE (11)..(11): Xaa at position 11 is Asp, Glu, Ser or Thr
RXXYSEXTFAXGERIT

SEQ ID NO: 179 - protein, 30 aa, Artificial Sequence; identical to SEQ ID NO: 153
  PtIP-65 amino acid Motif
  MISC_FEATURE (1)..(1): Xaa at position 1 is Asn, Gln, Ser or Thr
  MISC_FEATURE (3)..(3): Xaa at position 3 is Ser, Thr, Arg or Lys
  MISC_FEATURE (6)..(6): Xaa at position 6 is Ala, Glu or Asp
  MISC_FEATURE (7)..(7): Xaa at position 7 is Gly, Asp, Glu, Thr or Ser
  MISC_FEATURE (9)..(9): Xaa at position 9 is Ile, Lue, Val, Asp or Glu
  MISC_FEATURE (10)..(10): Xaa at position 10 is Pro, Thr or Ser
  MISC_FEATURE (11)..(11): Xaa at position 11 is Lys, Arg, Ile, Val or Leu
  MISC_FEATURE (14)..(14): Xaa at position 14 is Thr, Ser, Ile, Leu or Val
  MISC_FEATURE (15)..(15): Xaa at position 15 is Phe, Ile, Val or Leu
  MISC_FEATURE (16)..(16): Xaa at position 16 is Ser or Ala
  MISC_FEATURE (20)..(20): Xaa at position 20 is Thr, Ser, Asn or Gln
  MISC_FEATURE (23)..(23): Xaa at position 23 is Ile, Thr, Leu, Ser or Val
  MISC_FEATURE (26)..(26): Xaa at position 26 is Ser or Thr
  MISC_FEATURE (28)..(28): Xaa at position 28 is Ser, Thr, Lys or Arg
  MISC_FEATURE (29)..(29): Xaa at position 29 is Leu, Ile, Val, Ser or Thr

SEQ ID NO: 180 - protein, 22 aa, Artificial Sequence
  PtIP-65 amino acid Motif
  MISC_FEATURE (1)..(1): Xaa at position 1 is Gln, Asn or Gly
  MISC_FEATURE (2)..(2): Xaa at position 2 is Glu, Asp or Val
  MISC_FEATURE (3)..(3): Xaa at position 3 is Gly, Arg or Lys
  MISC_FEATURE (5)..(5): Xaa at position 5 is His, Asn or Gln
  MISC_FEATURE (6)..(6): Xaa at position 6 is Asn, Gln, Thr or Ser
  MISC_FEATURE (10)..(10): Xaa at position 10 is Asn, Gln, Glu or Asp
  MISC_FEATURE (13)..(13): Xaa at position 13 is Val, Ile, Leu or Ala
  MISC_FEATURE (14)..(14): Xaa at position 14 is Glu, Gln, Asp, Asn, Arg or Lys
  MISC_FEATURE (16)..(16): Xaa at position 16 is Cys, Arg, Lys, Thr or Ser
  MISC_FEATURE (17)..(17): Xaa at position 17 is Lys, Arg, Ser or Thr
  MISC_FEATURE (18)..(18): Xaa at position 18 is Leu, Ile or Val
  MISC_FEATURE (21)..(21): Xaa at position 21 is Ala, Ile, Leu, Val, Ser or Thr
XXXDXXVQPXKEXXEXXXLFXE

SEQ ID NO: 181 - protein, 36 aa, Artificial Sequence; identical to SEQ ID NO: 155
  PtIP-65 amino acid Motif
  MISC_FEATURE (1)..(1): Xaa at position 1 is Ile, Met, Leu or Val
  MISC_FEATURE (2)..(2): Xaa at position 2 is Gln, Asn, Asp or Glu
  MISC_FEATURE (4)..(4): Xaa at position 4 is Ser or Thr
  MISC_FEATURE (6)..(6): Xaa at position 6 is Ala, Thr or Ser
  MISC_FEATURE (7)..(7): Xaa at position 7 is Asn, Gln, Glu or Asp
  MISC_FEATURE (9)..(9): Xaa at position 9 is Thr, Ser, Leu, Val or Ile
  MISC_FEATURE (11)..(11): Xaa at position 11 is Ser, Arg, Lys or Thr
  MISC_FEATURE (13)..(13): Xaa at position 13 is Asn, Ala, Gln, Glu or Asp
  MISC_FEATURE (14)..(14): Xaa at position 14 is Glu, Asp or Ala
  MISC_FEATURE (19)..(19): Xaa at position 19 is Cys or Gly
  MISC_FEATURE (21)..(21): Xaa at position 21 is Ile, Leu or Val
  MISC_FEATURE (25)..(25): Xaa at position 25 is Leu, Val or Ile
  MISC_FEATURE (30)..(30): Xaa at position 30 is Ser, Thr, Ile, Val or Leu
  MISC_FEATURE (31)..(31): Xaa at position 31 is Leu, Val or Ile
  MISC_FEATURE (32)..(32): Xaa at position 32 is Pro, Leu, Val or Ile
  MISC_FEATURE (33)..(33): Xaa at position 33 is Lys, Arg, Thr or Ser
  MISC_FEATURE (34)..(34): Xaa at position 34 is His, Lys or Arg
  MISC_FEATURE (35)..(35): Xaa at position 35 is Arg, Ala, Ser, Lys, Thr, Ile, Leu or Val

SEQ ID NO: 182 - protein, 42 aa, Artificial Sequence; identical to SEQ ID NO: 156
  PtIP-65 amino acid Motif
  MISC_FEATURE (1)..(1): Xaa at position 1 is Trp, Pro, Phe or Tyr
  MISC_FEATURE (2)..(2): Xaa at position 2 is Asp, Thr, Gln, Glu, Ser or Asn
  MISC_FEATURE (3)..(3): Xaa at position 3 is His, Asn, Gln, Ile, Leu or Val
  MISC_FEATURE (4)..(4): Xaa at position 4 is Val, Leu or Ile
  MISC_FEATURE (5)..(5): Xaa at position 5 is Ala or Gly
  MISC_FEATURE (7)..(7): Xaa at position 7 is Val, Leu or Ile
  MISC_FEATURE (8)..(8): Xaa at position 8 is Arg, Lys, His, Tyr or Trp
  MISC_FEATURE (10)..(10): Xaa at position 10 is Ser, Thr, Asn or Gln
  MISC_FEATURE (13)..(13): Xaa at position 13 is Arg, Lys, Ile, Val or Leu
  MISC_FEATURE (14)..(14): Xaa at position 14 is Gly, Ile, Val or Leu
  MISC_FEATURE (16)..(16): Xaa at position 16 is Thr, Ser, Ile, Val or Ile
  MISC_FEATURE (19)..(19): Xaa at position 19 is Tyr, Trp or Phe
  MISC_FEATURE (21)..(21): Xaa at position 21 is Ser, Thr or Met
  MISC_FEATURE (22)..(22): Xaa at position 22 is Ser or Thr
  MISC_FEATURE (23)..(23): Xaa at position 23 is Arg or Val
  MISC_FEATURE (24)..(24): Xaa at position 24 is Glu, Asp, Asn or Gln
  MISC_FEATURE (26)..(26): Xaa at position 26 is Ser or Thr
  MISC_FEATURE (28)..(28): Xaa at position 28 is Gln, Lys, Asn or Arg
  MISC_FEATURE (29)..(29): Xaa at position 29 is Trp, Tyr, Ile, Leu or Val
  MISC_FEATURE (30)..(30): Xaa at position 30 is Phe, Ile or Thr
  MISC_FEATURE (31)..(31): Xaa at position 31 is Thr, Ser, Asp or Glu
  MISC_FEATURE (32)..(32): Xaa at position 32 is Val, Ile, Leu or Ala
  MISC_FEATURE (42)..(42): Xaa at position 42 is Val, Ile, Leu or Met

SEQ ID NO: 183 - protein, 41 aa, Artificial Sequence; identical to SEQ ID NO: 157
  PtIP-65 amino acid Motif
  MISC_FEATURE (2)..(2): Xaa at position 2 is Ser or Thr
  MISC_FEATURE (4)..(4): Xaa at position 4 is Asn, Gln, Ser or Thr
  MISC_FEATURE (6)..(6): Xaa at position 6 is Gln, Gly, Asn, Ile, Val or Leu
  MISC_FEATURE (8)..(8): Xaa at position 8 is Thr, Ser or Ala
  MISC_FEATURE (10)..(10): Xaa at position 10 is Asp, His or Asn
  MISC_FEATURE (11)..(11): Xaa at position 11 is Gln, Asn or His
  MISC_FEATURE (12)..(12): Xaa at position 12 is Asp or Glu
  MISC_FEATURE (14)..(14): Xaa at position 14 is Pro, Asn or Gln
  MISC_FEATURE (18)..(18): Xaa at position 18 is Glu, Asn, Asp or Gln
  MISC_FEATURE (19)..(19): Xaa at position 19 is Gln, Asn, Arg or Lys
  MISC_FEATURE (23)..(23): Xaa at position 23 is Glu, Asn, Asp or Gln
  MISC_FEATURE (29)..(29): Xaa at position 29 is Ser, Thr, Lys or Arg
  MISC_FEATURE (34)..(34): Xaa at position 34 is Ser, Thr, Trp, Tyr or Phe
  MISC_FEATURE (35)..(35): Xaa at position 35 is His, Ile, Val or Leu
  MISC_FEATURE (36)..(36): Xaa at position 36 is Ser or Thr
  MISC_FEATURE (38)..(38): Xaa at position 38 is Ser, Thr, Leu, Val or Ile

SEQ ID NO: 184 - protein, 16 aa, Artificial Sequence
  PtIP-65 amino acid Motif
  MISC_FEATURE (1)..(1): Xaa at position 1 is Leu, Ile, Val or Met
  MISC_FEATURE (2)..(2): Xaa at position 2 is Ala, Val, Ile, Leu, Phe or Tyr
  MISC_FEATURE (3)..(3): Xaa at position 3 is Gln, Asn, Ile, Val or Leu
  MISC_FEATURE (4)..(4): Xaa at position 4 is Thr, Ser, Ile, Leu or Val
  MISC_FEATURE (5)..(5): Xaa at position 5 is Pro, Leu, Val or Ile
  MISC_FEATURE (6)..(6): Xaa at position 6 is Val, Ile, Leu or Gly
  MISC_FEATURE (7)..(7): Xaa at position 7 is Tyr, Trp, Ser or Thr
  MISC_FEATURE (8)..(8): Xaa at position 8 is Val, Leu or Ile
  MISC_FEATURE (15)..(16): Xaa at position 15 is Ser, Asn, Thr or Asn
  MISC_FEATURE (16)..(16): Xaa at position 16 is Ala, Gln, Asn, Thr or Ser
XXXXXXXXIGGQGGXX

SEQ ID NO: 185 - protein, 16 aa, Artificial Sequence
  PtIP-65 amino acid Motif
  MISC_FEATURE (10)..(10): Xaa at position 10 is Thr, Ile, Leu or Val
  MISC_FEATURE (11)..(11): Xaa at position 11 is Asn, Gln, Thr or Ser
  MISC_FEATURE (12)..(12): Xaa at position 12 is Thr, Ser, Asn or Gln
  MISC_FEATURE (16)..(16): Xaa at position 16 is Ala, Glu or Asp
GVDYTSVDIXXXGTRX

SEQ ID NO: 186 - protein, 50 aa, Artificial Sequence; identical to SEQ ID NO: 160
  PtIP-65 amino acid Motif
  MISC_FEATURE (1)..(1): Xaa at position 1 is Leu, Ile, Val, Phe or Trp
  MISC_FEATURE (2)..(2): Xaa at position 2 is Val, Leu or Ile
  MISC_FEATURE (6)..(6): Xaa at position 6 is Arg, Lys, Thr or Ser
  MISC_FEATURE (8)..(8): Xaa at position 8 is Thr, Ser, Glu or Asp
  MISC_FEATURE (9)..(9): Xaa at position 9 is Ala, Gln or Asn
  MISC_FEATURE (11)..(11): Xaa at position 11 is Pro, Asn or Gln
  MISC_FEATURE (15)..(15): Xaa at position 15 is Asn, Gln, Lys or Arg
  MISC_FEATURE (19)..(19): Xaa at position 19 is Phe, Ile, Val or Leu
  MISC_FEATURE (21)..(21): Xaa at position 21 is Ser, Thr, Glu or Asp
  MISC_FEATURE (22)..(22): Xaa at position 22 is Gly, Ala, Thr or Ser
  MISC_FEATURE (23)..(23): Xaa at position 23 is Gly, Ala, Glu or Asp
  MISC_FEATURE (24)..(24): Xaa at position 24 is Asn, Gly, Gln or Tyr
  MISC_FEATURE (25)..(25): Xaa at position 25 is Asn, Asp, Gln, Glu or Gly
  MISC_FEATURE (26)..(26): Xaa at position 26 is Leu, Ile, Val or Phe
  MISC_FEATURE (29)..(29): Xaa at position 29 is Ala or Gly
  MISC_FEATURE (30)..(30): Xaa at position 30 is Thr or Ser
  MISC_FEATURE (32)..(32): Xaa at position 32 is Ser or Thr
  MISC_FEATURE (36)..(36): Xaa at position 36 is Arg, Gly, Lys, Asn or Gln
  MISC_FEATURE (37)..(37): Xaa at position 37 is Leu, Ser, Ile, Thr or Val
  MISC_FEATURE (38)..(38): Xaa at position 38 is Leu, Ile, Val or Phe
  MISC_FEATURE (40)..(40): Xaa at position 40 is Asp, Asn, Gln, Glu, Thr or Ser
  MISC_FEATURE (41)..(41): Xaa at position 41 is Gly or Ala
  MISC_FEATURE (42)..(42): Xaa at position 42 is Gly, Lys or Arg
  MISC_FEATURE (46)..(46): Xaa at position 46 is Asp, Asn, Gln, Glu, Ser or Thr
  MISC_FEATURE (49)..(49): Xaa at position 49 is Val, Leu or Ile
  MISC_FEATURE (50)..(50): Xaa at position 50 is Leu, Val or Ile

SEQ ID NO: 187 - protein, 12 aa, Artificial Sequence
  PtIP-65 amino acid Motif
  MISC_FEATURE (1)..(1): Xaa at position 1 is Leu, Ile, Val or Phe
  MISC_FEATURE (2)..(2): Xaa at position 2 is Glu, Gln, Asn or Asp
  MISC_FEATURE (3)..(3): Xaa at position 3 is Gln or Thr
  MISC_FEATURE (4)..(4): Xaa at position 4 is Ala or Gln
  MISC_FEATURE (7)..(7): Xaa at position 7 is Ile, Val, Ser, Leu or Thr
  MISC_FEATURE (9)..(9): Xaa at position 9 is Val, Ile, Thr, Leu, Ser, Asn or Gln
  MISC_FEATURE (10)..(10): Xaa at position 10 is Thr or Ala
  MISC_FEATURE (12)..(12): Xaa at position 12 is Asp or Lys
XXXXGIXPXXLX

SEQ ID NO: 188 - protein, 9 aa, Artificial Sequence
  PtIP-65 amino acid Motif
  MISC_FEATURE (1)..(1): Xaa at position 1 is Ala, Val, Ile, Leu, Thr or Ser
  MISC_FEATURE (4)..(4): Xaa at position 4 is Ile, Leu or Val
  MISC_FEATURE (5)..(5): Xaa at position 5 is Cys, Tyr or Trp
  MISC_FEATURE (6)..(6): Xaa at position 6 is Val, Ile, Leu or Ala
  MISC_FEATURE (8)..(8): Xaa at position 8 is Ile, Val, Leu or Phe
  MISC_FEATURE (9)..(9): Xaa at position 9 is Thr, Ile, Leu, Met, Ser, Val, Lys or Arg
XSGXXXGXX

SEQ ID NO: 189 - protein, 16 aa, Artificial Sequence
  PtIP-65 amino acid Motif
  MISC_FEATURE (2)..(2): Xaa at position 2 is Gly, Asp or Glu
  MISC_FEATURE (3)..(3): Xaa at position 3 is Val, Ile, Leu or Ala
  MISC_FEATURE (4)..(4): Xaa at position 4 is Gln, Glu, Asn, Asp or Ala
  MISC_FEATURE (5)..(5): Xaa at position 5 is Lys, Gln, Asn or Arg
  MISC_FEATURE (6)..(6): Xaa at position 6 is Thr, Ser, Ile, Val or Leu
  MISC_FEATURE (11)..(11): Xaa at position 11 is Ser, Thr or His
  MISC_FEATURE (12)..(12): Xaa at position 12 is Arg, Lys, Glu or Asp
  MISC_FEATURE (14)..(14): Xaa at position 14 is Ala, Pro, Thr or Ser
DXXXXXFGDPXXPXGE

SEQ ID NO: 190 - protein, 22 aa, Artificial Sequence
  PtIP-65 amino acid Motif
  MISC_FEATURE (2)..(2): Xaa at position 2 is Thr, Leu or Pro
  MISC_FEATURE (3)..(3): Xaa at position 3 is Ala or Glu
  MISC_FEATURE (8)..(8): Xaa at position 8 is Asn, Thr or Ala
  MISC_FEATURE (10)..(10): Xaa at position 10 is Gly, Gln or His
  MISC_FEATURE (12)..(12): Xaa at position 12 is Glu or Gln
  MISC_FEATURE (14)..(14): Xaa at position 14 is Val or Ala
  MISC_FEATURE (16)..(16): Xaa at position 16 is Thr or Ala
  MISC_FEATURE (20)..(20): Xaa at position 20 is Thr, Ile, Leu, Val or Ser
GXXGASTXFXWXTXRXFPSXNA

SEQ ID NO: 191 - protein, 12 aa, Artificial Sequence
  PtIP-65 amino acid Motif
  MISC_FEATURE (1)..(1): Xaa at position 1 is Thr or Ser
  MISC_FEATURE (3)..(3): Xaa at position 3 is Asp, Ser, Thr, Gln, Glu or Asn
  MISC_FEATURE (4)..(4): Xaa at position 4 is Asp or Ser
  MISC_FEATURE (5)..(5): Xaa at position 5 is Thr, Ser, Gln or Asn
  MISC_FEATURE (7)..(7): Xaa at position 7 is Ala, His, Tyr, Arg, Ile, Lys, Leu, Val, Ser or Thr
  MISC_FEATURE (8)..(8): Xaa at position 8 is Thr, Val, Ser, Ile or Leu
  MISC_FEATURE (9)..(9): Xaa at position 9 is Phe, Tyr or Cys
  MISC_FEATURE (11)..(11): Xaa at position 11 is Thr or Ser
  MISC_FEATURE (12)..(12): Xaa at position 12 is Ala, Pro, Ile, Leu or Val
XGXXXPXXXGXX

SEQ ID NO: 192 - protein, 29 aa, Artificial Sequence
  PtIP-65 amino acid Motif
  MISC_FEATURE (3)..(3): Xaa at position 3 is Gln, Asn, Asp or Glu
  MISC_FEATURE (14)..(14): Xaa at position 14 is Leu, Ile, Val, Thr or Ser
  MISC_FEATURE (20)..(20): Xaa at position 20 is Asn, Gln, Thr or Ser
  MISC_FEATURE (27)..(27): Xaa at position 27 is Glu, Lys, Asp, Asn, Arg or Gln
  MISC_FEATURE (29)..(29): Xaa at position 29 is Leu, Ile, Val or Phe
DTXSSSLSSSSSLXLPWSRXGSLLPSXSX

SEQ ID NO: 193 - protein, 22 aa, Artificial Sequence
  PtIP-65 amino acid Motif
  MISC_FEATURE (3)..(3): Xaa at position 3 is Thr, Ser, Ile, Leu or Val
  MISC_FEATURE (4)..(4): Xaa at position 4 is Gly or Ala
  MISC_FEATURE (5)..(5): Xaa at position 5 is Asn, Arg, Gln, Lys, Thr or Ser
  MISC_FEATURE (6)..(6): Xaa at position 6 is Ala, Asn, Gln, Glu or Asp
  MISC_FEATURE (8)..(8): Xaa at position 8 is Ser, Thr, Ile, Val or Leu
  MISC_FEATURE (9)..(9): Xaa at position 9 is Ile, Val or Leu
  MISC_FEATURE (10)..(10): Xaa at position 10 is Asn, Gln, Glu or Asp
  MISC_FEATURE (11)..(11): Xaa at position 11 is Val, Ile Leu or Met
  MISC_FEATURE (12)..(12): Xaa at position 12 is Asp, Thr, Glu or Ser
  MISC_FEATURE (16)..(16): Xaa at position 16 is Asn, Gln, Glu or Asp
  MISC_FEATURE (17)..(17): Xaa at position 17 is Thr, Ser or Ala
  MISC_FEATURE (19)..(19): Xaa at position 19 is Thr, Ser, Arg or Lys
  MISC_FEATURE (20)..(20): Xaa at position 20 is Val, Leu or Ile
  MISC_FEATURE (22)..(22): Xaa at position 22 is Pro or Ala
HLXXXXIXXXXXLGIXXPXXVX

SEQ ID NO: 194 - protein, 12 aa, Artificial Sequence
  PtIP-65 amino acid Motif
  MISC_FEATURE (1)..(1): Xaa at position 1 is Lys, Leu, Arg, Ile, Val, Thr or Ser
  MISC_FEATURE (2)..(2): Xaa at position 2 is Asp, Lys, Arg, Gln, Glu or Asn
  MISC_FEATURE (3)..(3): Xaa at position 3 is Glu, His, Asn, Asp or Gln
  MISC_FEATURE (7)..(7): Xaa at position 7 is Glu, Asp, Asn or Gln
  MISC_FEATURE (9)..(9): Xaa at position 9 is Thr, Ser, Ile, Leu or Val
  MISC_FEATURE (10)..(10): Xaa at position 10 is Asp or Glu
XXXVEVXAXXQQ

SEQ ID NO: 195 - protein, 12 aa, Artificial Sequence
  PtIP-65 amino acid Motif
  MISC_FEATURE (2)..(2): Xaa at position 2 is Thr, Ser or Ala
  MISC_FEATURE (3)..(3): Xaa at position 3 is Ser or Thr
YXXTQEESRTLT

SEQ ID NO: 196 - protein, 31 aa, Artificial Sequence; identical to SEQ ID NO: 170
  PtIP-65 amino acid Motif
  MISC_FEATURE (1)..(1): Xaa at position 1 is Ala, Asn or Gln
  MISC_FEATURE (2)..(2): Xaa at position 2 is Arg, Lys, Ile, Leu or Val
  MISC_FEATURE (3)..(3): Xaa at position 3 is Val, Ile, Leu, Ser or Thr
  MISC_FEATURE (6)..(6): Xaa at position 6 is Ser or Thr
  MISC_FEATURE (7)..(7): Xaa at position 7 is Gly or His
  MISC_FEATURE (8)..(8): Xaa at position 8 is Gly, Thr or Ser
  MISC_FEATURE (9)..(9): Xaa at position 9 is Thr, Ser, Lys or Arg
  MISC_FEATURE (13)..(13): Xaa at position 13 is Ser, Thr or Pro
  MISC_FEATURE (16)..(16): Xaa at position 16 is Gln, His, Asn, Arg or Lys
  MISC_FEATURE (18)..(18): Xaa at position 18 is Ala, Phe, Leu, Ile, Val, Lys or Arg
  MISC_FEATURE (19)..(19): Xaa at position 19 is Phe or Tyr
  MISC_FEATURE (22)..(22): Xaa at position 22 is Gln, Asn, Asp or Glu
  MISC_FEATURE (24)..(24): Xaa at position 24 is His, Trp or Tyr
  MISC_FEATURE (25)..(25): Xaa at position 25 is Val, Ile, Leu or Ala
  MISC_FEATURE (26)..(26): Xaa at position 26 is Ile, Leu, Val or Pro
  MISC_FEATURE (27)..(27): Xaa at position 27 is Ala, Glu or Asp
  MISC_FEATURE (28)..(28): Xaa at position 28 is Ile, Leu or Val
  MISC_FEATURE (30)..(30): Xaa at position 30 is Thr, Ala or Ser

SEQ ID NO: 197 - protein, 16 aa, Artificial Sequence
  PtIP-65 amino acid Motif
  MISC_FEATURE (2)..(2): Xaa at position 2 is Ser, Thr, Ile, Leu or Val
  MISC_FEATURE (5)..(5): Xaa at position 5 is Pro, Ser or Thr
  MISC_FEATURE (6)..(6): Xaa at position 6 is Tyr, Phe, Trp, Lys or Arg
  MISC_FEATURE (7)..(7): Xaa at position 7 is Arg, Asp, Gly, Lys, Glu, Gln or Gln
  MISC_FEATURE (9)..(9): Xaa at position 9 is Asn, Asp, Ile, Gln, Glu, Leu, Val, Ser or Thr
  MISC_FEATURE (10)..(10): Xaa at position 10 is Val, Ala, Ile or Leu
  MISC_FEATURE (11)..(11): Xaa at position 11 is Asn, Ser, Gln, Thr, Lys or Arg
  MISC_FEATURE (12)..(12): Xaa at position 12 is Gly, Asp, Glu, Gln or Asn
  MISC_FEATURE (14)..(14): Xaa at position 14 is Pro, Phe, Arg, Lys, Thr or Ser
  MISC_FEATURE (16)..(16): Xaa at position 16 is Asn, Asp, Glu, Gln, Ser or Thr
LXALXXXGXXXXLXFX

SEQ ID NO: 198 - protein, 9 aa, Artificial Sequence
  PtIP-65 amino acid Motif
  MISC_FEATURE (2)..(2): Xaa at position 2 is Thr, Phe, Pro or Ser
  MISC_FEATURE (5)..(5): Xaa at position 5 is Glu, Gln, Asp, Asn, Thr or Ser
  MISC_FEATURE (6)..(6): Xaa at position 6 is Glu, Gln, Asp, Asn or His
  MISC_FEATURE (9)..(9): Xaa at position 9 is Asp, Glu or Ala
TXILXXLPX

SEQ ID NO: 199 - DNA, 2430 bp, Artificial Sequence
  modified for baculovirus expression
atggcagcgggtgactactctgttctgtaccaggatgtgaaccagatctctatccgtctggagaagatggacttcagcgaagttatggcagtgcaccgtatgttcgttcgtatggacgatctggacgtgtctagcggtactggtcttctgtctggtgctgagaaggtcaaacgtctgtacgtgtttgcagatgtcgttgaactgcctagcaaacagcttcgtcttccaggtaccgatctgatcgtaatcctgtgtcgtatcttcgtgaccaatggtcgtcacagcaccgaactgttcctgccgagcatgaacatgagcatggttgctccaggtactggctctattcgtggtgtgattctgtctccaaccactgtactgactactagctctgatgctctgcagttcaagcttcagtctggtagcatgacctcggtaatgcgtctgaaggacgtatcagtagcagctacccttacctgcaacgtacaggctgcaagtgcatccatgccactgactgtcaagactactggtacttctccaggcaacatctgtgtactgggcatgtctactgcagttgtggtaccagagtctgcagttgcagttatcaccgatgcgaacatccttctgggtatgcaggttactgttctgatcgctgaactggtgaagatcgcacacaactccgacgttctgatcgctgcagttactcgtcacgtggaatggcttaaccaccttcttgtgcaagctcatgcagctgcaccttccgaagatgtggttgcactgctgtatcgtactcaaggcttcatcaagctgcgtaacgaaggcctgattgtgccacgtctgcagtatcgtatgtacaaggacctgatcgatcgcatggttcaggtagctcagtcctatgaccaggacttcaagcagctgaaactgttcgtcgagcagaacaagatcctgggttcctatctgctggagcagaacaaggctttcgctgagaaggagaaggacatggatgcgttccactcccaagtcatcgaccttcgtacttctgaactggagagcacgattgagcgtatggacgatctgtccaagcagatggaagagcagaacgctgctatggaacaggcgaaagctgacatggatgcaggtctgattgcctaccagaacaagcaggttgcgaatgctgtgttcgcagttcttggagcgattgctagcattggtcttgcgtttgcaactggtggtgctactgctccaggtgctgttgcatctgcaggtgcagctgttactgcagctggcaaagctgctgaaggtctgaagaaggttgtcgagatcctggaaggtctgcaagcagtgatggaagtcgtagctgtgatcaaagagctggtgcagtcactgcaggagattggtcaactggtagacgctcctgagatgcctgatcttccgagtgatgctgagtgggaaatcttcgtcaacgaggttgaagcagttgctgaacagatgcctacggaagtgactgaggtaccagcttggaaagcgaagtgcaagaacgttgcagctcttggtcgcgaaatgtccactatggcagctcatatcgcagagctgcaattcgagatccaggtgcaagagatgcttcgtgagattgccaagaagcaggctgatcgtctgagctccatcaaacctgctgatctgacgaactacctcgagatggtctctgagatggacatgcgtacaactcgcatgctccttgagctgattcgtgtcctctacatccagaacgctgcacttcagtacgagtacttgcaaacgccagctccgttgaatgcttggcctgttaccatgcagaccgtatggggtcttctggtacaacaggagactgctgccatcaatggtctgctccaaatgggtgcaccttctgactacacccaggagtatgctgtacgtgacgttccagttcgtctgcttcttggtggtggtgattgggagttcgaattgcctgtacgcaatgcagactttccattgacctggtgtcgtgttcgcattcgttacgtcgatatgcgcttcgatgcagctgctgaacatcttccagtgacctctactggtgaagtgtacatgctgctccaatcctctcgcttcttcgaggatcgtgcgaaacgtgagaacgagttcatcagctacgaaggtggtatgggtctgcagtaccaatatgcctatcgcttggcaactggagatgctactgtcaccaacgttccgtctgaagagtatgccaacacgttcatgcgtcttgcaccattcactcgttggcgtcttcgcctttctgctagcgcacctgagaacaagggtcttgcatttccaactgcaactttggcagatgctaccactcgcatcaagatcaccttccacgtgtctgcgatccgtcgtatcagtactcgtgtagcagtctaa

SEQ ID NO: 200 - protein, 809 aa, Artificial Sequence; identical to SEQ ID NO: 71
  modified for baculovirus expression

SEQ ID NO: 201 - protein, 5 aa, Artificial Sequence
  fusion protein linker
EEKKN

SEQ ID NO: 202 - DNA, 24 bp, Artificial Sequence
  primer
cgaattcgagcacatatggccgcc

SEQ ID NO: 203 - DNA, 29 bp, Artificial Sequence
  primer
gattccggatccttatacggcgactctgg

SEQ ID NO: 204 - DNA, 30 bp, Artificial Sequence
  primer
ggatacacctcatatggcgttggtgatcgg

SEQ ID NO: 205 - DNA, 36 bp, Artificial Sequence
  primer
gtgcgggatccctactgagtggtgatgtcaatcgcg

SEQ ID NO: 206 - DNA, 2448 bp, Artificial Sequence
  encoding tagged PtIP-50 polypeptide
atggccgccggcgattacagtgtgctatatcaggatgtgaaccagatcagcatcagactagagaagatggacttctcggaggtgatggcagtgcaccgtatgttcgtccggatggatgatctcgacgtgagctccggcaccggactcctgtctggcgcagaaaaggtgaagcgcctgtacgtctttgcggatgtggtagagttgccatccaaacaactgcggcttccaggcacagacttgattgtcatactctgtcgcatctttgtcacaaatggccgccacagcacggagctgttcctgccctccatgaacatgagcatggtcgcccctggtaccgggagcattcggggagtgattctcagccccacaacggtactgacaacttcatccgacgccttgcagttcaagctgcaaagcggctccatgacatcagtcatgcggctcaaagacgtgagtgtggctgctacactcacctgcaatgttcaggctgcatcggcatccatgcccctgactgtcaagacaaccggcacatcgcccgggaacatctgcgttctgggcatgagcacagccgtcgttgttccagagagcgctgtggctgtcatcactgatgccaatattctgttgggcatgcaagtaacggtgctcatcgccgagctagtcaagattgcccacaactcggatgttctcattgctgcagtcactcggcacgtggaatggttgaaccacctattagttcaggcacatgccgctgctcccagtgaggatgttgtcgcgctcttatatcggacacaaggtttcatcaaactgcgaaacgaaggcttaattgttccgcggttgcaatatcgcatgtacaaagatctcattgatcgaatggtgcaagtggctcagagctacgaccaagacttcaagcagttgaagctgttcgtggaacaaaataagatacttgggagctatttgctagagcaaaacaaggcgtttgctgagaaggaaaaagacatggatgcttttcactcccaagtcattgatctcaggacttctgagcttgaaagcaccattgagagaatggatgacttaagcaaacaaatggaagaacaaaatgcagcaatggagcaagccaaagcggacatggacgcagggttgatagcgtatcaaaacaaacaagtcgcaaatgccgtctttgcggtcttgggggcgatcgccagtattggtctggcatttgcaactggcggggcaactgctcctggagccgtggcttccgcaggagcagctgttaccgcagctgggaaggcagctgagggattgaagaaagtggtagagattcttgaaggcttacaagcggtgatggaggtcgtcgctgtcataaaagagctggtacagtccttacaggagatagggcagcttgtggatgcccctgagatgccagatctgccgtcggatgcagaatgggagatttttgtgaatgaagtggaggcagtagcagagcagatgccaacagaggtgacagaggtgcctgcttggaaggccaagtgcaagaatgtggcagcactaggccgagaaatgagcactatggcggcgcacattgcagagttgcagttcgagatacaagtgcaagaaatgttgcgcgagatcgcgaagaaacaggcagataggctgtcgtccatcaagcccgcagacttgacgaactacttggagatggtgtccgaaatggacatgcgcacaacgcgcatgctgttggagctgattcgagtgctgtacatccagaacgcagcattgcagtacgaatatctgcagacaccggcgccattgaatgcatggccagtgacgatgcaaacggtgtgggggttgcttgtgcaacaagagacggccgcaattaacgggctgctgcagatgggggcgccctcggactacacacaagagtatgcggtgagagatgttcctgtgaggttgttactagggggtggagactgggagtttgagctgccagtgaggaatgctgatttcccactgacatggtgccgagtgcgcatacgatatgtggatatgcgatttgatgctgcagccgagcacctgcccgtcacaagcacgggggaagtgtacatgctgctgcagagttctcgcttcttcgaggatcgcgccaagcgtgagaacgagttcattagctacgagggcggcatgggccttcagtatcagtatgcctaccgcttggccacgggcgacgccaccgtcaccaacgtccccagcgaggagtatgccaatacttttatgcgcctcgcacccttcactcgttggcgcctccgcctttcggcctccgcgcccgagaacaagggcctcgcatttccaaccgccaccttggccgatgccaccacacgaatcaaaatcacctttcacgtctctgccattcgccgtataagcaccagagtcgccgtaggcgcagctgagccagaggcc

SEQ ID NO: 207 - protein, 816 aa, Artificial Sequence
  tagged PtIP-50 polypeptide
MAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAVGAAEPEA

SEQ ID NO: 208 - DNA, 1095 bp, Artificial Sequence
  encoding tagged PtIP-65 polypeptide
atggcgtacccatatgatgtgccagattatgcttacccatatgatgtgccagattatgctgagaacctgtacttccaaggcgcgttggtgatcggtggccttattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaacggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatcgacgctctgggggtggtcttcttgcagcgcatccagagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctccagctcttcctctctcttactcccttggtcgcgcagtgggtccttgctcccttcaaaatccttcgccctttccgctctgccttatcgcggtaatgtcagtggcctctcctttaatggctcggcccgagtgactaccagcggtggcacgttctccttctccgggctgcaaggtagattcaccggccaaagctacgcgattgacatcaccactcag

SEQ ID NO: 209 - protein, 365 aa, Artificial Sequence
  tagged PtIP-65 polypeptide
MAYPYDVPDYAYPYDVPDYAENLYFQGALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQ

SEQ ID NO: 210 - DNA, 3549 bp, Artificial Sequence
  encoding PtIP-50/PtIP-65 fusion protein
atggccgccggcgattacagtgtgctatatcaggatgtgaaccagatcagcatcagactagagaagatggacttctcggaggtgatggcagtgcaccgtatgttcgtccggatggatgatctcgacgtgagctccggcaccggactcctgtctggcgcagaaaaggtgaagcgcctgtacgtctttgcggatgtggtagagttgccatccaaacaactgcggcttccaggcacagacttgattgtcatactctgtcgcatctttgtcacaaatggccgccacagcacggagctgttcctgccctccatgaacatgagcatggtcgcccctggtaccgggagcattcggggagtgattctcagccccacaacggtactgacaacttcatccgacgccttgcagttcaagctgcaaagcggctccatgacatcagtcatgcggctcaaagacgtgagtgtggctgctacactcacctgcaatgttcaggctgcatcggcatccatgcccctgactgtcaagacaaccggcacatcgcccgggaacatctgcgttctgggcatgagcacagccgtcgttgttccagagagcgctgtggctgtcatcactgatgccaatattctgttgggcatgcaagtaacggtgctcatcgccgagctagtcaagattgcccacaactcggatgttctcattgctgcagtcactcggcacgtggaatggttgaaccacctattagttcaggcacatgccgctgctcccagtgaggatgttgtcgcgctcttatatcggacacaaggtttcatcaaactgcgaaacgaaggcttaattgttccgcggttgcaatatcgcatgtacaaagatctcattgatcgaatggtgcaagtggctcagagctacgaccaagacttcaagcagttgaagctgttcgtggaacaaaataagatacttgggagctatttgctagagcaaaacaaggcgtttgctgagaaggaaaaagacatggatgcttttcactcccaagtcattgatctcaggacttctgagcttgaaagcaccattgagagaatggatgacttaagcaaacaaatggaagaacaaaatgcagcaatggagcaagccaaagcggacatggacgcagggttgatagcgtatcaaaacaaacaagtcgcaaatgccgtctttgcggtcttgggggcgatcgccagtattggtctggcatttgcaactggcggggcaactgctcctggagccgtggcttccgcaggagcagctgttaccgcagctgggaaggcagctgagggattgaagaaagtggtagagattcttgaaggcttacaagcggtgatggaggtcgtcgctgtcataaaagagctggtacagtccttacaggagatagggcagcttgtggatgcccctgagatgccagatctgccgtcggatgcagaatgggagatttttgtgaatgaagtggaggcagtagcagagcagatgccaacagaggtgacagaggtgcctgcttggaaggccaagtgcaagaatgtggcagcactaggccgagaaatgagcactatggcggcgcacattgcagagttgcagttcgagatacaagtgcaagaaatgttgcgcgagatcgcgaagaaacaggcagataggctgtcgtccatcaagcccgcagacttgacgaactacttggagatggtgtccgaaatggacatgcgcacaacgcgcatgctgttggagctgattcgagtgctgtacatccagaacgcagcattgcagtacgaatatctgcagacaccggcgccattgaatgcatggccagtgacgatgcaaacggtgtgggggttgcttgtgcaacaagagacggccgcaattaacgggctgctgcagatgggggcgccctcggactacacacaagagtatgcggtgagagatgttcctgtgaggttgttactagggggtggagactgggagtttgagctgccagtgaggaatgctgatttcccactgacatggtgccgagtgcgcatacgatatgtggatatgcgatttgatgctgcagccgagcacctgcccgtcacaagcacgggggaagtgtacatgctgctgcagagttctcgcttcttcgaggatcgcgccaagcgtgagaacgagttcattagctacgagggcggcatgggccttcagtatcagtatgcctaccgcttggccacgggcgacgccaccgtcaccaacgtccccagcgaggagtatgccaatacttttatgcgcctcgcacccttcactcgttggcgcctccgcctttcggcctccgcgcccgagaacaagggcctcgcatttccaaccgccaccttggccgatgccaccacacgaatcaaaatcacctttcacgtctctgccattcgccgtataagcaccagagtcgccgtagccgcaggcggtgccgcaggcgcgggtgccgcagcgttggtgatcggtggccttattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaacggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatcgacgctctgggggtggtcttcttgcagcgcatccagagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctccagctcttcctctctcttactcccttggtcgcgcagtgggtccttgctcccttcaaaatccttcgccctttccgctctgccttatcgcggtaatgtcagtggcctctcctttaatggctcggcccgagtgactaccagcggtggcacgttctccttctccgggctgcaaggtagattcaccggccaaagctacgcgattgacatcaccactcaggagaacctgtacttccaaggctacccatatgatgtgccagattatgcttacccatatgatgtgccagattatgct

SEQ ID NO: 211 - protein, 1183 aa, Artificial Sequence
  PtIP-50/PtIP-65 fusion protein
MAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAVAAGGAAGAGAAALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQENLYFQGYPYDVPDYAYPYDVPDYA

SEQ ID NO: 212 - DNA, 1038 bp, Artificial Sequence
  encoding tagged PtIP-65 polypeptide
atggcgttggtgatcggtggccttattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaacggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatcgacgctctgggggtggtcttcttgcagcgcatccagagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctccagctcttcctctctcttactcccttggtcgcgcagtgggtccttgctcccttcaaaatccttcgccctttccgctctgccttatcgcggtaatgtcagtggcctctcctttaatggctcggcccgagtgactaccagcggtggcacgttctccttctccgggctgcaaggtagattcaccggccaaagctacgcgattgacatcaccactcagggcgcagctgagccagaggcc

SEQ ID NO: 213 - protein, 346 aa, Artificial Sequence
  tagged PtIP-65 polypeptide
MALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQGAAEPEA

SEQ ID NO: 214 - DNA, 1092 bp, Artificial Sequence
  encoding tagged PtIP-65 polypeptide
atggcgttggtgatcggtggccttattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaacggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatcgacgctctgggggtggtcttcttgcagcgcatccagagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctccagctcttcctctctcttactcccttggtcgcgcagtgggtccttgctcccttcaaaatccttcgccctttccgctctgccttatcgcggtaatgtcagtggcctctcctttaatggctcggcccgagtgactaccagcggtggcacgttctccttctccgggctgcaaggtagattcaccggccaaagctacgcgattgacatcaccactcaggagaacctgtacttccaaggctacccatatgatgtgccagattatgcttacccatatgatgtgccagattatgct

SEQ ID NO: 215 - protein, 364 aa, Artificial Sequence
  tagged PtIP-65 polypeptide
MALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQENLYFQGYPYDVPDYAYPYDVPDYA

SEQ ID NO: 216 - DNA, 1071 bp, Artificial Sequence
  encoding tagged PtIP-65 polypeptide
atggcgttggtgatcggtggccttattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaacggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatcgacgctctgggggtggtcttcttgcagcgcatccagagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctccagctcttcctctctcttactcccttggtcgcgcagtgggtccttgctcccttcaaaatccttcgccctttccgctctgccttatcgcggtaatgtcagtggcctctcctttaatggctcggcccgagtgactaccagcggtggcacgttctccttctccgggctgcaaggtagattcaccggccaaagctacgcgattgacatcaccactcagtacccatatgatgtgccagattatgcttacccatatgatgtgccagattatgct

SEQ ID NO: 217 - protein, 357 aa, Artificial Sequence
  encoding tagged PtIP-65 polypeptide
MALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQYPYDVPDYAYPYDVPDYA

SEQ ID NO: 218 - DNA, 3660 bp, Artificial Sequence
  encoding maltose binding protein / PtIP-50 polypeptide fusion
atggcaaagatcgaggagggaaagctcgtcatttggatcaacggcgataagggctacaacggactcgctgaagtcggcaagaagttcgagaaggacactggtatcaaggtgactgtggagcaccctgacaagttggaggagaagttcccacaggttgcagctactggagatggacctgacatcatcttctgggctcacgacagattcggaggttacgcacaatctggactccttgcagagatcactccagacaaggcctttcaggacaagctctatccattcacctgggatgcagtgaggtacaacggcaagctcattgcctatcccattgcagtcgaagcactgtccttgatctacaacaaggaccttctgcctaatcctcccaagacctgggaggagattccagcattggacaaggagctgaaggctaagggtaagtccgcactcatgttcaacctgcaagagccttacttcacctggccactcattgcagctgacggaggatacgctttcaagtacgagaacggcaagtacgacatcaaggatgtcggagtcgacaatgctggagctaaagccggactgaccttcctggtcgatctcatcaagaacaagcacatgaacgctgacaccgattactccatcgctgaggcagctttcaacaagggtgagactgccatgaccatcaacggaccttgggcatggtccaacatcgatacctccaaggtcaactacggagtgactgtgcttcctaccttcaaaggccaaccttccaagcctttcgtcggagtcctctcagcagggatcaacgctgcatcacccaacaaggagttggccaaggagttcctcgagaactaccttctcaccgacgaaggactcgaagccgtcaacaaggacaagcctctgggagcagtggctttgaagtcctatgaggaggagttggctaaggacccaaggatcgcagctactatggagaacgctcagaagggagagatcatgcccaacatccctcagatgtcagccttctggtatgccgtgagaaccgctgtcatcaacgctgcatctggaaggcagacagtcgacgaggctttgaaggacgcacagaccaactccagttccaacaacaacaacaacaacaacaacaacaatctcggtatcgaaggcaggatctccgagttgggcgccgcaggcggtgccgcaggcgcgggtgccgcagagaacctgtacttccaaggcatggccgccggcgattacagtgtgctatatcaggatgtgaaccagatcagcatcagactagagaagatggacttctcggaggtgatggcagtgcaccgtatgttcgtccggatggatgatctcgacgtgagctccggcaccggactcctgtctggcgcagaaaaggtgaagcgcctgtacgtctttgcggatgtggtagagttgccatccaaacaactgcggcttccaggcacagacttgattgtcatactctgtcgcatctttgtcacaaatggccgccacagcacggagctgttcctgccctccatgaacatgagcatggtcgcccctggtaccgggagcattcggggagtgattctcagccccacaacggtactgacaacttcatccgacgccttgcagttcaagctgcaaagcggctccatgacatcagtcatgcggctcaaagacgtgagtgtggctgctacactcacctgcaatgttcaggctgcatcggcatccatgcccctgactgtcaagacaaccggcacatcgcccgggaacatctgcgttctgggcatgagcacagccgtcgttgttccagagagcgctgtggctgtcatcactgatgccaatattctgttgggcatgcaagtaacggtgctcatcgccgagctagtcaagattgcccacaactcggatgttctcattgctgcagtcactcggcacgtggaatggttgaaccacctattagttcaggcacatgccgctgctcccagtgaggatgttgtcgcgctcttatatcggacacaaggtttcatcaaactgcgaaacgaaggcttaattgttccgcggttgcaatatcgcatgtacaaagatctcattgatcgaatggtgcaagtggctcagagctacgaccaagacttcaagcagttgaagctgttcgtggaacaaaataagatacttgggagctatttgctagagcaaaacaaggcgtttgctgagaaggaaaaagacatggatgcttttcactcccaagtcattgatctcaggacttctgagcttgaaagcaccattgagagaatggatgacttaagcaaacaaatggaagaacaaaatgcagcaatggagcaagccaaagcggacatggacgcagggttgatagcgtatcaaaacaaacaagtcgcaaatgccgtctttgcggtcttgggggcgatcgccagtattggtctggcatttgcaactggcggggcaactgctcctggagccgtggcttccgcaggagcagctgttaccgcagctgggaaggcagctgagggattgaagaaagtggtagagattcttgaaggcttacaagcggtgatggaggtcgtcgctgtcataaaagagctggtacagtccttacaggagatagggcagcttgtggatgcccctgagatgccagatctgccgtcggatgcagaatgggagatttttgtgaatgaagtggaggcagtagcagagcagatgccaacagaggtgacagaggtgcctgcttggaaggccaagtgcaagaatgtggcagcactaggccgagaaatgagcactatggcggcgcacattgcagagttgcagttcgagatacaagtgcaagaaatgttgcgcgagatcgcgaagaaacaggcagataggctgtcgtccatcaagcccgcagacttgacgaactacttggagatggtgtccgaaatggacatgcgcacaacgcgcatgctgttggagctgattcgagtgctgtacatccagaacgcagcattgcagtacgaatatctgcagacaccggcgccattgaatgcatggccagtgacgatgcaaacggtgtgggggttgcttgtgcaacaagagacggccgcaattaacgggctgctgcagatgggggcgccctcggactacacacaagagtatgcggtgagagatgttcctgtgaggttgttactagggggtggagactgggagtttgagctgccagtgaggaatgctgatttcccactgacatggtgccgagtgcgcatacgatatgtggatatgcgatttgatgctgcagccgagcacctgcccgtcacaagcacgggggaagtgtacatgctgctgcagagttctcgcttcttcgaggatcgcgccaagcgtgagaacgagttcattagctacgagggcggcatgggccttcagtatcagtatgcctaccgcttggccacgggcgacgccaccgtcaccaacgtccccagcgaggagtatgccaatacttttatgcgcctcgcacccttcactcgttggcgcctccgcctttcggcctccgcgcccgagaacaagggcctcgcatttccaaccgccaccttggccgatgccaccacacgaatcaaaatcacctttcacgtctctgccattcgccgtataagcaccagagtcgccgta

SEQ ID NO: 219 - protein, 1220 aa, Artificial Sequence
  maltose binding protein / PtIP-50 polypeptide fusion
MAKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGAAGGAAGAGAAENLYFQGMAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAV

SEQ ID NO: 220 - DNA, 2280 bp, Artificial Sequence
  encoding maltose binding protein / PtIP-65 polypeptide fusion
atggcacatcatcaccatcaccaccatcaccatcacaagatcgaggagggaaagctcgtcatttggatcaacggcgataagggctacaacggactcgctgaagtcggcaagaagttcgagaaggacactggtatcaaggtgactgtggagcaccctgacaagttggaggagaagttcccacaggttgcagctactggagatggacctgacatcatcttctgggctcacgacagattcggaggttacgcacaatctggactccttgcagagatcactccagacaaggcctttcaggacaagctctatccattcacctgggatgcagtgaggtacaacggcaagctcattgcctatcccattgcagtcgaagcactgtccttgatctacaacaaggaccttctgcctaatcctcccaagacctgggaggagattccagcattggacaaggagctgaaggctaagggtaagtccgcactcatgttcaacctgcaagagccttacttcacctggccactcattgcagctgacggaggatacgctttcaagtacgagaacggcaagtacgacatcaaggatgtcggagtcgacaatgctggagctaaagccggactgaccttcctggtcgatctcatcaagaacaagcacatgaacgctgacaccgattactccatcgctgaggcagctttcaacaagggtgagactgccatgaccatcaacggaccttgggcatggtccaacatcgatacctccaaggtcaactacggagtgactgtgcttcctaccttcaaaggccaaccttccaagcctttcgtcggagtcctctcagcagggatcaacgctgcatcacccaacaaggagttggccaaggagttcctcgagaactaccttctcaccgacgaaggactcgaagccgtcaacaaggacaagcctctgggagcagtggctttgaagtcctatgaggaggagttggctaaggacccaaggatcgcagctactatggagaacgctcagaagggagagatcatgcccaacatccctcagatgtcagccttctggtatgccgtgagaaccgctgtcatcaacgctgcatctggaaggcagacagtcgacgaggctttgaaggacgcacagaccaactccagttccaacaacaacaacaacaacaacaacaacaatctcggtatcgaaggcaggatctccgagttgggcgccgcaggcggtgccgcaggcgcgggtgccgcagagaacctgtacttccaaggcatggcgttggtgatcggtggccttattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaacggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatcgacgctctgggggtggtcttcttgcagcgcatccagagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctccagctcttcctctctcttactcccttggtcgcgcagtgggtccttgctcccttcaaaatccttcgccctttccgctctgccttatcgcggtaatgtcagtggcctctcctttaatggctcggcccgagtgactaccagcggtggcacgttctccttctccgggctgcaaggtagattcaccggccaaagctacgcgattgacatcaccactcag

SEQ ID NO: 221 - protein, 760 aa, Artificial Sequence
  maltose binding protein / PtIP-65 polypeptide fusion
MAHHHHHHHHHHKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTNSSSNNNNNNNNNNLGIEGRISELGAAGGAAGAGAAENLYFQGMALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQ

SEQ ID NO: 222 - DNA, 1050 bp, Artificial Sequence
  encoding His-tagged PtIP-65 polypeptide
atggcgttggtgatcggtggcctcattggcgggcaaggtggctacgccttcaactactacgggggcacggacgggagggtaatgcagcggatcaaggtatgggccgccacgagccgcatcaaagccatttcagtgtggcttagcgacggtgtggagaggacgttcggggacccaagtcggcccgctggcgaaggcgacttgaggacatcagagttccgcttcaactcgggcgagaccgtgacgagtctgtcgttatggggaaatggcgcaggcacgcgatcgggctggatatacttccggacaagtcagaacaggacgttcgatttcggaatgtacagctggggcaagaagacggagtacccacaatctgtagcttcgggcatctgggtaggcattaggggaagagcatcgtctgatatagatgctctgggggtggtcttcttgcagcgcatacaaagctgccgactcactagcgttcaatacccgacgctgcagttcagcggttcgtcgggcggcactaccagcattgttcgcacaacccccactaagtccttcaatctcggaaacaccgcagatcaggacgatccctccagtacggaacaactcgcctggcagctggctgacgagcccagctttgacaatgtctctcactcatggtccctctccaacacctccaccggcctgttgcagttcatcgcgacctccaccgtctctgtgcaagcccgcacccccgctctcgctgtcgtcaatgatgtcgtcggttggcagctcagtgcctccgatacccaatcctcttctctctcctcctcttcctctctcttactcccttggtcgcgcagtgggtccttgctcccttcaaaatccttcgccctttccgctctgccttatcgcggtaatgtcagtggcctctcctttaatggctcggcccgagtcactaccagcggtggcacgttctccttctccgggctgcaaggtagattcaccggccaaagctacgcgattgacatcaccactcagcaccatcaccatcaccatcaccatcaccattaa

SEQ ID NO: 223 - protein, 349 aa, Artificial Sequence
  His-tagged PtIP-65 polypeptide
MALVIGGLIGGQGGYAFNYYGGTDGRVMQRIKVWAATSRIKAISVWLSDGVERTFGDPSRPAGEGDLRTSEFRFNSGETVTSLSLWGNGAGTRSGWIYFRTSQNRTFDFGMYSWGKKTEYPQSVASGIWVGIRGRASSDIDALGVVFLQRIQSCRLTSVQYPTLQFSGSSGGTTSIVRTTPTKSFNLGNTADQDDPSSTEQLAWQLADEPSFDNVSHSWSLSNTSTGLLQFIATSTVSVQARTPALAVVNDVVGWQLSASDTQSSSLSSSSSLLLPWSRSGSLLPSKSFALSALPYRGNVSGLSFNGSARVTTSGGTFSFSGLQGRFTGQSYAIDITTQHHHHHHHHHH

SEQ ID NO: 224 - protein, 932 aa, Adiantum peruvianum
MATFEEYHPEQYMELYKDFNQVRERLSLEMMEFSEVMVIHRMYLKLEELDVGHLEGAEKVKHLYVFADVVEMRSREDELEPVARLPGSVSVAIICRVLWIRRQGSVTRETLIAFPHLKVHLKMTGARSVNVYRTHHAAETDDGFVLCIDAGSIQRTSDESTTSGILFSLFSYHFVRSPTLDGKNITFSSDTDSSISNLPVVHFPFYTQGWRWSVTTAGILSFAPSSVTSTTTVHATGSLQTYDFTHLTFAPGFWIMRGIPESLLKDDKLLLFLQTSLLISELAELAHPSSETRNAVLTHVEWLSKILINGESKTEGTEFHHEMQTSLLISELAELAHPSSETRNAVLTHVEWLSKILINGESKTEGTEFHHEYLALSFRAQYMLKTARSTRSLVVPQLQYDVYGPLINRMAQVAQIYDDAINQLKLFVSQNKILGSYLLEQNKTFAARERDMEVFYAELISQMKIELDSTLLKMDQLGAQMEAQSADMEEAQREMEEGLRRFRNRQVAEAMFSVFRAIGAIALAFLTGGATAPAAMSSARRAVTAAEQAARALARVLDILEGLQAVMEVVAIIKDLVESLQNVGQLVDAPDMPEMPTEADWGIFVNEIEGVAEEMPEEVSEVSAWKTKCKNVAVLGRELMTTAAYISRLQYDIQEHAMLQEIARRHADRLSTIQAADLSSYTEMVTQMDMRTTRIMVSLIKVIYMQNAALMYQCLAPPTQVWQWPSLSMETVWTMLMQNEHVAILGLTRLGPSFDFKRIYVVRDIPVSLLLAGQDWEFEIPVSDHTTFPSTWSRVRIQHLEMKFDAGGGAHQPITDTGKVYILLQGSRAFHDRNQVGRLPLLYEAALPLDYHYAYRLDTGETTLSNLPSTNFLDTYMRMTPFTNWRLRLSASAEENKGLDFPTARQESSIKEEATTQIAITFHVSAIRQISF

SEQ ID NO: 225 - protein, 728 aa, Adiantum peruvianum
TNHRHDKELFLPSMNMSMAAAGDMSFLGVNVSTTTVSSSSDVLEFKLQSGSMTSAMRLKDVDAAATLTCIVQTASPSMPLSVMTTGASPGNVWVLGMTTAVVVPASAVAVITDANILLGMQVTVQVAELVKTTHNSDVVIAASTRHVEWLNQLLVQAHAVAPNEDIVTLLYRTQALLKLQREGLVVPRLQYHMYKSLIDRMVQVAQSYDQDFNRLKLFVEQNKILGSYLLEQNKAFAEKEKEMDAFHAQVIELRTAELNGTIDRMDQLSEQMDKENEAMEQAKADMDAGLVEYQNRQVANALFAVLGAIASIGLAFATGGATAPAAVSAAGAAVTAAGQAAAGLRKVIEILEGLQVVMEVVAAIKELVQSLQEIGKLVDAPEMPELPSNADWEIFVNEVEAVAEQMPTEVTEVAAWKAKCKNVAALGREMSTMAAHIAELQYQIQVQEMLREIAQRQADRLSSIRPADLTNYLEMVSEMDMRTTRMLLELIRVLYIQNAALQYEYLQTPAPLSAWPVTMSTVWNLLVQQETAAITGLLELGPPSDFTREYAVKDIPVSLLQEGQDWEFELPVFSADFPSAWSRVRIHHLAMQFDGSAATHVPTTRTGKVYILLQSSRFFDDRAKRANELISYQAGMGLFYQYAYRLSTGEATVTNIPTDEYANTFMRSTPFTRWRIRLSSSAEENEGLAFPTATTADATTQIKITFSVSAIRRVSTRALTANGVVAKW

SEQ ID NO: 226 - protein, 525 aa, Adiantum hispidulum
VRMCAGSCTHANFIEAGSQERRNYLFPSLIISVCACVCVFQFPPLDGVDARSCIKMEYSSLYGDVNQVSLRFEKTEVSEVMVVHRMHVRLEELDMSSDKLKRLYVLADVVELPSQRSTIVVPATVSAIIICRVLYIPYIFTVLENCSFFLSLMRFRVVETRIEPPRTGQFFALPSADAVDDGVGGFRGLYILADRFIYRQATSFTSDWVQPLGLRVRGSSTFSYRQATSFTSDWVQPLSLRVQGSSTFSSTFRPEWPETLPVTNLNHTVTLSLGSFLTPSDSDLQRSDEIEFLPTEPQRVQVVINRGPGSQTGLVLIPENSPEISETEPQRVQVVVNRGPGSQTGLVLVVENSPEISFFPAPSLEHVPADVLADPSIILGMQMNMLSAELVLAAHNSQQVIKAVTKHVEWLNKILLQVASPSDDILALLFRAQAFIKMAKQSRFVVPRLQYHVYRNLINRMVQVAQDYDQELRQLRLFIAQNEILGSYLLQQNKAFAEKEKDMSDFHLQVVSMRRSLGKLFATAK

SEQ ID NO: 227 - protein, 904 aa, Adiantum hispidulum
MAAAAPAARRRDYKELYQDLNQISERMRLDQMDFSEVMVIHRMYIKLEELDLGHLEGAHKVKRLYVLADVVEVEEGSNLHDQGPLARLPGSILVVILCRVLLVGIFVNVRTGTLLNNVMRLQLPHIKLRAVEVRSSITDSNFTLQMHRAQSTGEIYDQYPALTINADLVQCRMRWVHQQPSITSVSLSPRFFAFMPDRGSQDVIFSSESRSMVDRPVQIFYIYSNVLNVIRSHRLPFPEEVTIDLASWEHKEFYYLHVSTAPSVTLSKPSETIQATELEPAFSLLKRSVPAAVLTDPNILLAMQASLLIAELVEIAHPSPDTADEVAKHVEWLNKLLIQAASEREGTSSHHEYLTLLFRAQYIMKKIGRARHLVVPQLQYDVYSGLINRMAQIAESYDQSLRQLILFIQQNKILGSYLLQQNRAFADKERDMDVFYSELISQREVELQSTLLKMDQLSLQMETQREDMEQAQKDMEAGLRRFQNRAVANAMFAVLGAVAAIGLAFLTGGATAPGAMAAAGNAVTIAGQAARALQRVLDILDGLQVVMEVVSLIKELVSSLQDLGQLVEAPEMPEMPLESDWFIFENSIEEVAEGMPEEVSEVSAWRTKCKNVAVLGREMISTAVYISQLMYDIKVQGMLQEIAKSHAQRLEAIQAADMQSYTEMVTQMDMRTTRMLVELIKVVYMQNAALMYQSLSPPTSVNAWPVTMETVWNILLQHDHAALLGLMRLGPSFDFMRTYIVQDIPVSLLLDGEDWQFEIPVRDFTSFPSTWSRVRIHHLEMKFVKATHVHQPITDTGSIYLLLQGSRIFRDRNEDETIDYEAALPLDYHYAYRLDTEETTLSNLPSQEFTKTFMRMTPFSNWRLRLSSSAEENKGLAFPTATSADSTTQIAITFYVTAIRRISF

SEQ ID NO: 228 - protein, 699 aa, Adiantum pedatum L.
RRAPCGGFSRSRTATGFSRLPANTGGQRVARVWQPISDYVDLFASVLPLNFARATHFVSSFEPAFWILTRGIPDSLLKDDKFLLAMQTSLLISELAQLAHPSSETRTAVLEHVRWLSAIVVDGASKTKGTELHREYLALSFRAQYMLKTASSTRSSLVVPQLQYDVYSPLINRMAQVTQIYDDALNQFKLFITQNGMHGSYLLEQNKALAARERDMEVFYSELISQMKIELDSTLLKMDQLGAQMEAQTEDMEQAQREMEQGLRRFKNRQVARAMFSVFAAIGAVALTFLTGGAAAPAAMSAARTAVTAAEQAARALQRVLDILEGLQAVMEVVALIKELVESLQDVGKLVEAPDMPEMPTEADWEIFVNEIEGVAAEMPEEVSEVSAWKTKCKNVAVLGREMTTTAAYISRLQYDIKEHAMLQEIAKRHADRLSTIQAADLSSYTEMVMQIDLRTTRIMVSLIKVIYMQNAALMYQYLAPPTHVWQWPSLSMEAVWTMLMQNEHIAILGLIRLGPSFDFKRTYVVRDIPVSLMLAGEDWEFTIPLSDHTTFPSTWSRVRIQHLEMKFVDDDDAASVHQPITNTGKVYILLQGSRAFHDRNQVGRLPLLYEAALPLDYHYAYCLDTGETTLSNLPSTSFLDTFMRMTPFTNWRLRLSVSAEENQGLDFPTARQQGTINEEATTQIAITFHVSAIRHVSF

SEQ ID NO: 229 - protein, 896 aa, Adiantum pedatum L.
MQLSGGQGQVYQSIMAAAAREYSELYKDLNQISERIRLDQMEFSEVMVIHRMFIRLEELDLGHLEGAERVKRLYVFADVVEVEEGGNFIETGPLARLPGSIMVVILCRVLSVRVLMFDNGNNAMRLQLPHMKLRVVEITTQPTTKLQIHRADAEDYQYPALCIHADVIQASIRLSSSSNRPPMDLRFFNFRPNRGSDNVVFSSESRSLIDEPVEIFYVYSHIPRFIHALPIPEAATVDPASRSNDWYYVSLRRVNSTLSSSVAAEGELEPAFSLLKPKIPVVVLTDPNILLAMQTSLLIAELVEVAHPSAETADAVAKHVEWLNKILLQATKVEGILNSSHDEHLALLFRAQYLMKMRPGRTRNLVVPQLQYDVYSNLVNRMAQVAESYDQSLRQFKLFIDQNKILGSYLLQQNKAFADKERDMDVFHSELISQRKIELDNTILKMDQLSLQMESQREDMDQAKKDMDAGLREFQNRQVANAMFAVIGAIAAIGLAFITGGATAPAAVGAAKTAVTAAGAAARALERVVEILDSLQAVMEIVSIIKELVSSLQEIGQLVEAPDMPPMPTEADWFIFENEIEGVAEQMPTEVSEVSAWKTKCKNVAVLGREMITTATYISELQYDIKVQGMLQEIATSHANRLSSIQATDLSNYTEMVTQMDMRTTRMLVALINVVHMQNAALMYQCLSPPTYVNAWPVTMETVWSMLVQHEHAAVLGLMRLGPSFDFMRTYVVEGIPVQLLLDGEDWEFEISVEDYTTFPSTWSRVRIHHLEMKFVQAADVHQPITDTGKVYMLLQGSRIFRDRNRADAIRYEAAMSLDYHYAYRLDTGETTLSNLPSQDFTRTFMRMTPFTNWRLRLSASAEENKGLGFPTATSAGSTTQIAIIFYISAIRRISL

SEQ ID NO: 230 - protein, 845 aa, Adiantum pedatum L.
VDYESIYKNAHEIGTVVGTDKIPCSEVMVCHRMYVNLDTFRVEQLVGYANVKQLIVFADVVEISCRWTYKLFLPFHTDFRIVCRLLKMKDDHEAIYLDWQRMDGRWMDSLYLPFHTDLRIVCRLLRMTEDHASIHLDWQLVNNSRCAIYAQELVSSTSNTPRLNLLVSRRTIHTNVPDRIIDIKNIVLYYNSQRDYDFTYFDEKTKVEYSYSVSVHFGSTPSVEVLAEDNILTGLQSTILITEMILNYRADLQDAVTAAFAHVTWVNLCLLQVVGRTDVKGADKLLSLLARVQALLKLPTDGSQSLIVPRLEYSAYEKLIAQMATVVESYNNEFVQLSLFIQQNEIMADYLLEQNKVFAAKEKDIAELESMIVDRKSQEMVKAFEKMNSLDAQLAQQVEEMDRAKEQMDAGIQKYKNDQVAKAFFSVIKCILSVGLAIVTGGAASGAAVAGTVAVVEKVSELANMLTKVTEILEGLEALAEILSAIKNLFEAIEDVNNIVEAPEMPEMPSAADWDIFENEIEAVAEQMPQTVSEVSLWKAKCKNVAAVCREISTTAAYIGQLEYDLFLHRKQQEIAAAQAKRLESIQPADLTNYLEMATQLDMRTTRLLVGMHKILTVQNGALQYHYLLEPKLLTGWPTMDRIRSRLVQNEQNAVLALERLGFSTDFVKTYVLSDVPVHLLLSGEDWNFNILEDDPTFPSNWSRVRIVYLEIKFSGDHLPITSTGEVYFLLQASRVFHDRLEGAYLKYEAGTPLEYQYAYILQTGKTTVTNKPTEEEDGKFLRMTPFTKWRLRLSASADENKGLSFPSAANALDSTTQISITFYLTAIRKISTRHGELGTTSDNE

SEQ ID NO: 231 - protein, 851 aa, Adiantum pedatum
MDVDYAAIYKDVNQVTRTVATSQCSEVMAIQRLYVRLNDLDVKGLRNVEVVKQVVVFADVVEVEGGDVLELPGSTQITIVCRVLHTKHPSGAVIRLSSLAPVKCHGREHRHASGPRTHSVTPMNGQLASDGQIVTILATEVVAPAGASLQVQCPVLVDAKIYDSDGYHPDFFYDLNGTASWSSLPFGGATGTTAATARSFQTTTIAPLSWITWTMNEVDWQPSFRVVLPETLPPRLLVNSSILLAMETNILASELISEFQREAVQTTAAVHQHTIWLDDQFQLAVRSSQRQDQLQSQQIRNLHFRVQSLLKLHRMDSNAPLVVPPLQYEQYDKLINLMTQAAQSYDNDFKNLNLFMQQNEILGNFLLDQNKAFAQKERDMEVHHSQLVGLQDRELELTREKFDSLLITLDQQNREMEKAQADLEAGIKQYRDRQIALAVFGALLAVAQLCFAVFTGGATAGAAVATAVQLSETAKVLQSVVKLLQRIEKVVTTLYAFIDFLSEMQSLEQIVNAPEMPELPTAADWYIFENEIVAVAETMPTEISEVPVWKAKCKNVAAVGREIITTAVYMQKLQYDLAVNRMLQQIAQQQAERLESLQIKDLDNYLEMATELDMRTTRILMGLLKVLSLQTGALSYHYLLEPRPLTGWVRMDAVWNALLKNATDAVVALSTSGASNDFVVRYTIKGIPVNLLLEGMDWIFDIPVDDPAFGESHWSRVRIEYIEMKFDSSSDGHLPTTTGGQIYFRLQAGRFFDDRLGHQILHYEAAVPLVYQYAYRLASGETTVSNRPSLSSSTHYMRMTPFTRWGLRLSASAPENRGLAFPTATTEDATTQITLTFYVTARRRISNFFLH

SEQ ID NO: 232 - protein, 766 aa, Adiantum pedatum
HYGFKANRYCAAGGVVIRLSSLSPVDCSAKLITDTTDIKPDDTVLQIDDFNWEVTPKTAAGRVVTILASHLVAPVGAQLRVHCPVNVEYQTNVIWPPVFTTVAGTVEWRISPYSAGASAAQSFAAATTSTFAGTAGLIWTVLKKWYPSFKIVLPEVIPLELLANSNIVLGVEVTTLVSELIMAYQRQATETVAATLHHVEWLNAQLLSAQSSGQLQALHFRVQSLLKLTVDDDNAPLVVPPLQYEVYDGLINVMTRAAESYDNAFVQLNLFMQQNEILGSFLLDQNKAFAAKERDMETHHSQLVSLQDAELTKTNESIKSMNNELAQQNQAMDKAKADMEAGIKQYKDRLIAEAVFGVFTAIAQVCLAIFTGGATAAAAVETAGKLSETAKALESAVKHLEKLQKIVQVINSITDFLSNLQSLNQLIEVPKMPDLPTEADWDMFENEIVAVAEGMPTEISEVPMWKAKCKNVAALGREIIRTVAYMQQLQYDLAVNRMLQNIAQQQAERLEGLHIQDLDNYTEMATELDTRTNRLLMGLLKVLSLQTGALSYHFLLPPRSLQGWVNMDTVWNTLVKNEYDAVRGLGSLGSAPTDTIQTYVVRDIPVGLLLEGNDWFFDIPVDDPAIPPPWFRVRIEHVELKFPTTNPIVHRPTTRNGEVYILLQAARFFSDRLIDEVLHFQATKTVSYQYAYRLDSGETTLHNRPTASSSTHYMRMTPFTRWRLRLSASAPQNEGLAFPTATTEDATTQITINFHLTALHRIQFRA

SEQ ID NO: 233 - protein, 881 aa, Adiantum pedatum
MAQGKELLTVDGVVDYEALYGEVNEIARAVRTHKVSCSEVMVINRMFVRLDTFSVEHLQQPGVVKSFIVVADVVEIEGSSSSLTLPGSSLILIVCRRLQLKNKNVILDLTWNLAATNVKSSQLPRCSIYTQHVDVPNAGSTLRIQVKRELKWSNGSSFTHYFGREFSYSNSTKTFSTTSSAPANYSVSSVGQPPASKLILVNSRKMNILTNDIRWKGFIDLQVNALPPLNDLAHPNVIEAFESNLLIVEMILNYQTNMQDLVTAAKDHVQWINQSFLEVVDWSNPEVGLQLKALLGRAQLLLKMPSDGSQSLIVPQLEYDGYDRVIQEMAKVAESYNREFRELSGLILNNEIIGQNILKQSKILGAKETEVQNLESLIVLRKEKELDRAIERLELLQNQLIRQVNEMETAKEKLDQGLKEYKHKQIARAFFQVLGAMMQIMGSCRLSSIPDFAVAFGGGISAAISAAEKVEDASVRNTLQNVANKLRNVEIVMEVVNSVKDLYTNASNLEDILNSPQIPDVPSSDWEIMRNDMEEVAAGMPTEVSEVSTWQAKSKNVVAVCEEICATAISISQTQCDLFVHVKQQEIAQRQAERLNQMQAVDLGDYLEMATQLDMRTMRVLICLLKMLGIQNGALQYQYLLAPKPFIGWPTIDTVRMEILRRVELAVLAKVELGSPVMLTRNYVIESIPVGLLISGDDWNFSFDASDNSVFPSTWSQVRIQYLEMKFTGEHCPITETGEVYLLLQASSKFEDRWKKQVFQYEAAAPLTYQYAYNLQSGKTTIPNKPHVEGTFLRMTPFTRWRLRLPASALENRGISFPTTTSLDNFISISITFHLTAIAQIQSKSLGIVYNLFDDDDDDDDEQGEGGEQGGGKSRGEEEVL

SEQ ID NO: 234 - protein, 890 aa, Adiantum pedatum
MAGAEDESMSTMYEGISTGSTAASDDELQDDMSFMYNYIQKSVDADRDSDYEAIYNGVNQIARAVGIRNRVESGEVLAIHQMFVRLDTLSVGNLLRAERVKYLIVFADVVEIEGADLTLPGSDLVLIACRLLRVKNQNVVLNLSWNIASSSTPPRCSICAQRVIITSSTAVANCTLRIQVMHALQWSDKSPFTQYFGRKFAYSSQNSSITAAPPNESSSSLGKPPSSRLILVNSKTMNILINNIRWKGYIDFQVGLPSSDDLIDPRVIEGIESTLLIAEMILTYQTNARDAVEAAKKHVQWINMALLQVVDSQNSEAGLRQKTLLARIQMLLKLSMDGTPGLVVSVLEYGIYDRVIQDLIRVAELYNNEFNQLNLFIQQNQILGDYVLEQSKVLAEREKDVEALESSIVARKQDELKESINTVESLEEQLQRLASEMEDAKDKMDKGLQAYRDKQIAYAFFTVLGAALQLGGSLKLSSSVEMVIGIGATVSEAVNATKEVTNAVASNNLMEVANKLVDVEKVIKVVNAIKELHDNETKLDDILTAPMMPVISSSDWDIMEDNIEEVAATMPTEVSEVVTWKTKSKNVIAVCREICTTAISVSETQYELFVHGKQQEIARRHTERLMKMKAADLGDYIEIAKQVDMQTMRLLIILLGNLAIQQGALHYHFLLAPEPLMSWPTIDTVRRHLIQQAEKAVWAEERMGEPVKLTQIYVLEDIPVSLLLAGNDWIFTIEPSETTVFPSNWYRVRIRYIEMKFTGENLPQSPETGRVYLLLQASSTFQDRSRGREVFQYEAATPRNYHFAYEVQSGVTTVHNEAAEGGRRFLMTPFTRWRLRLSASAIENQGVSFPVATSATISITFHLTCIVRVQSYRSQEDDEDEDEDEDEDGL

SEQ ID NO: 235 - protein, 883 aa, Adiantum pedatum
MVNERFLVDLDERSEEFVKDAQTRSTVSTEVDYEHLYANANQLARDLRTRNVRCGEVLAVHRMFVRLDSLDVQQLQQAERVKRLIVFADVVEIQGSSVALPGSSLVLIVCRVLHLKSRDVQLDLPFAWDTTAHDSPRCSIRAQQVVVSPSAAPPHLSSDGSLIIRVTHNMGWSNGSSFSQYIVRCFGYSESNSNSSVHINLPVATTRPPSFHWMRVDSEKVSIRINQNIDWTAHINFQVALPSADDLDNLHVVMGIESTLLIAEMILSYRSDRQDVVAAALEHTQWISMSLAQKEVVEGQPKSDLHELKLALLARAQMLQKLPLDGSQSLVVPQLEYGAYSEVIREMTDVAEAYNREFIQLHLFIQQNEILGDYILTAVRNLAEKEKDVASLEDAVVRGKEREIEIAMEKITTLEGQLLKQIEEMTDARDAMEQGVIVYRNKRIASATFEVLGAVLQIAGSIALFATGQIASGLGALGGGISAAVAAAEAVEDAASIKDSLLNVTDQLVEVEVAMEVVNAIQKLVASATDLEDLLAAPPMPIIYSSAWDIMENEVESVAAQMPTAVSEVPVWKAKCKNVVAVSREVCTTAIAISHLQYELFVHARKQEIALRQAERLAEMQAVDLGECLELASQADMRTTRMLINLLDMLATQNGALQYHYLLPPAPFVGWPAIDSVRTLLVQRRQQAIIAQTTMGPSYKVNTRVTLDSIPVGLLLSGEDFSFTIQAISEDTIATFPDVWSRVRIEDLSIVFTGGHQPSSSTTGEVYLLLQPSSSFHDRLRHQVLNYEAAAPRPFQYAYNLSTGHPTLTSRPHEEGLYLRMTPFTRWRLRLSSSAYQNRGISFPTATAPDSSTEITITFDLTAIVHPQTSVEYDNNPEIVDQP

SEQ ID NO: 236 - protein, 877 aa, Adiantum raddianum
MDVDYAADAMDVDYAEIYKEVNQVTRPVPTRVCSEVMSIQRMYFQLDDLDAKLLRNTEVVKRLYVFADVVEMVGQSVELAASVEVVILCRIFKTTRSDAVLRFLSLTSRLECDATPVYASANVVSHFFVRPRPGAADPRLLITIHATQLVAPARTQLRVQRPNVVLHRAQFWALEEIFMPGGVSTGATQPVLRPAVTQDGAMEWRISPYVAGGALAARSFHFTHPHVYRTSQDYLGFTGIFIPEPIPYDLLTNSNIWLGMECTTLICELIDKYQRQATQTVEAAHHHVAWLDKQLLSMGNRITSSNIPKKNVQQIETLHFRVQSLLKIYRRTANGVDAPLIVPSLQYDVYDRIINLMTRAAESYDNDFKQLNLFIQQNEILGSFLLDQNRAFAQKERDMENHHLQLVTLQGHELQATGDKLQALNRQLAEQSEAMDQAKADMDAGIKEYRDAMIANAIFSVFKAIAALCLAAATGGAAAGAAAGAAVDTAAQLSELARVLQSVVKLLKRIENVVKTINAITAFLTELESLNQLIELPEMPEMPTDADWSIFENEIEAVAEGMPTEISEVPAWKAKCKNVAAVGREIITTVAHVEKLQYEISVSKMLQDIAQQQAERLEGLRIEDLDNYLEMATELDMRTNRILMGLLDMLSLQTGALSYHYLLRPRPFTGWVRMETVWRTLLQNESDKLVAIAALGAPQEFSRSYVVENIPVSLLKEGADWIFDIPVHDPVFPSLWSSVRIDYVEMKFPPDTTHLPTTKGGKVYFLLQAARFFHDRLQEDEVLHYQAAVPLVYQYAYHVESGETTLSNRPPQASSALYMRMTPFTRWRLRLSASAPENEGLEFPTATTEDATTEIAITFFVTARRRISTRVDSSSTT

SEQ ID NO: 237 - protein, 874 aa, Adiantum raddianum
MAAVQDFSDVEDFSELYKNAEHVQMGSVPDYYEIYKNVNQVTRAVASSQCSEVMSIHRMCFKLDMLDVKLLTKADTVKRLIVFADVVEIEGDMVELPASTEVTIVCRILSVKKENRQVEENVQVFFNLLESVVTAGDRNDRPAGISLSTSPEFRFCIYAQQVVSNSVVHLRVTQPVTYSDPGFTPPDADTAWMWLSMRIRNLPSRQHMLNANGPRKANGMPVWQTSRNVIERGPEWSRISVLAPVSVPLHTLADPTVILGMQSTLLIAELILSYQTDLPDTVSAAVQHVEWLNTKLLRVVDDNTLDMETTQELLALLARGESLLKMPVDGSHTLIVPRLEYGQYRGLISSMATVAEAYNREFMQVDLFIQQNEILGSYLLQQNKALAERERDMEAFNGLVVARKQEELRAAEERMKELEALLTQQTEAMDQAQEDMEAGLKRYRDEQVARAFFSVLKGVFAIGVAIATGGAAAGPAVKGAVGAVNAVSGLARTLSTVTKIMEMMVQVIEVLNAMKDLIAAISELNQMVEAPQMPTMPSTVEWDIFENEMEEVAESMPEEVTEARTWKTKCKNVAAVCREISTTAAYIGQLHYDLFVHYNQEAIARRQAERLEAIQPANLTNYLEMATQMDMRTSRMLMGLLKVLMLQNGALQFHYLLQPKPFTGWVTMGMVRDALVQHEADALLARERLGPSTDFTQTYVVSDIPLSLLLEGEDWTFHIPPDDSTFPLSWSRVRIRYLEMNFTGGEEFHRPTTNTGRVYMLLQASRFFQDRLLGEVLHYEAAVPLRYQYAYDLKSGETTTSNRPSDQHDGEFMQMTPFNQWRLRLSASADENRGLAFPTAPPDQLDGSNTQISITFYLTAVRRAATRTSEISSQ

SEQ ID NO: 238 - protein, 882 aa, Adiantum trapeziforme
MATFEEYHPEQYMELYKDFNQVRERLSLEMMEFSEVMVIHRMYLKLEELDVGHLEGAEKVKHLYVFADVVEMRSREDELEPVARLPGSVSVAIICRVLWIRRQGSVTRETLIAFPHLKVHLKMTGARSVNVYRTDHAAETDDGFVFCIDAGSIQRTSDESTTSGILFSLFSYHFVRSPTLDGKNITFSSDTDSSISNLPVVHFPFYTQGWRWSVTTAGILSFAPSSVTSTTTVHATGSLQTYDFTHLTFAPGFWIMRGIPESLLKDDKLLLFMQTSLLISELAELAHPSSETRNAVLTHVEWLSKILINGESKTEGTEFHHEYLALSFRAQYMLKTARSTRSLVVPQLQYDVYGPLINRMAQVAQIYDDAINQLKLFVSQNKILGSYLLEQNKTFAARERDMEVFYAELISQMKIELDSTLLKMDQLGAQMEAQSADMEEAQREMEEGLRRFRNRQVAEAMFSVFRAIGAIALAFLTGGATAPAAMSSARRAVTAAEQAARALERVLDILEGLQAVMEVVAIIKDLVESLQNVGQLVDAPDMPEMPTEADWGIFVNEIEGVAEEMPEEVSEVSAWKTKCKNVAVLGRELMTTAAYISRLQYDIQEHAMLQEIARRHADRLSTIQAADLSSYTEMVMQMDMRTTRIMVSLIKVIYMQNAALMYQCLAPPTQVWQWPSLSMETVWTMLMQNEHVAILGLTRLGPSFDFKRIYVVRDIPVSLLLAGQDWEFEIPVSDHTTFPSTWSRVRIQHLEMKFDAGGGAHQPITDTGKVYILLQGSRAFHDRNQVGRLPLLYEAALPLDYHYAYRLDTGETTLSNLPSTNFLDTYMRMTPFTNWRLRLSASAEENKGLDFPTARQESSIKEEATTQIAITFHVSAIRQISF

SEQ ID NO: 239 - protein, 893 aa, Adiantum trapeziforme
MAAPAATEHGGLDYRELYKDLNQISDSLMLDQMEFSEVMVIHRMYIKLEELDLGHLEGADKVKRLYVFADVVDVEDGGNFIDVGPLARLPGSMTVVILCRVLYVRVLPLAVGGNNNAMRMQLPHMKFRVVEIATGRVQLQRVEQSGDELALCIHARIIQCYIRPSASATIRPPYSLRFLHFAPGRGVPGIVFSSEPRSMVDAQVELFQVYSHLGHVFQAPGPDQIVSINPASLATDWYYVSVSFPDRVVLSSSNAARGELEPAFSLLKPDIPVVVLTDPNVSLLIQTSLLIAELVELAHPSADTTAAVAEHLQWLNSLLLQATAEVKEGTASHDEYLGLLFRAQYLVKMMGRARSLVVPQLQYDVYSNLINRMAQVAESYDQALRQFRLFILQNKILGSYLLAQNRAFAEREKDMEVFHSELLSQRKLELETAIQKMDHLSIQMETQSADMEQAKKDMDEGLRRFQNAAVANAMFAVFGAIAAISLAFLTGGATAPGAVAAAKGAVTAAGALARALERVVEILEGLQAVMELVYLIKELMNSLKEVGQLVEAPEMPELPSEADWGIFVNEIEGVAEQMPTEVSEVSAWKTKCKNVAVLGREMITTATYISQLQYDIKVQDMLQGIARNQADRLLSIQAADLSNYTAMVTEMDMRTTRMLVALIKVVHMQNAALMYECLSLPMHVNAWPVTMETVWSMLVQHEHAAILGLMRLGPSFDFMSTYVAKDIPVSLLLDGEDWELDIPVDDYNTFPSTWSRVRIHHLEMKFVQGNEGSAGNIIHQPITDTGSVYLLLQGSRLFRDRNQSDVLNYEAAMSLDYHYAYRLDTGETTLSNLPSQDFTRTFMRMTPFTTWRLRLSASAQENQGLAFPTATSADSTTQIVITFYISAIRRISL

SEQ ID NO: 240 - protein, 833 aa, Asplenium australasicum
MRCPLNADITNSSRDGRRRLQCAKMAAGDYSVLYQDVNQISIRLEKMDFSEVMAVHRMFVRMDDLDVSSGTGLLSGAEKVKRLYVFADVVELPSKQLRLPGTDLIVILCRIFVTNGRHSTELFLPSMNMSMVAPGTGSIRGVILSPTTVLTTSSDALQFKLQSGSMTSVMRLKDVSVAATLTCNVQAASASMPLTVKTTGTSPGNICVLGMSTAVVVPESAVAVITDANILLGMQVTVLIAELVKIAHNSDVLIAAVTRHVEWLNHLLVQAHAAAPSEDVVALLYRTQGFIKLRNEGLIVPRLQYRMYKDLIDRMVQVAQSYDQDFKQLKLFVEQNKILGSYLLEQNKAFAEKEKDMDAFHSQVIDLRTSELESTIERMDDLSKQMEEQNAAMEQAKADMDAGLIAYQNKQVANAVFAVLGAIASIGLAFATGGATAPGAVASAGAAVTAAGKAAEGLKKVVEILEGLQAVMEVVAVIKELVQSLQEIGQLVDAPEMPDLPSDAEWEIFVNEVEAVAEQMPTEVTEVPAWKAKCKNVAALGREMSTMAAHIAELQFEIQVQEMLREIAKKQADRLSSIKPADLTNYLEMVSEMDMRTTRMLLELIRVLYIQNAALQYEYLQTPAPLNAWPVTMQTVWGLLVQQETAAINGLLQMGAPSDYTQEYAVRDVPVRLLLGGGDWEFELPVRNADFPLTWCRVRIRYVDMRFDAAAEHLPVTSTGEVYMLLQSSRFFEDRAKRENEFISYEGGMGLQYQYAYRLATGDATVTNVPSEEYANTFMRLAPFTRWRLRLSASAPENKGLAFPTATLADATTRIKITFHVSAIRRISTRVAV

SEQ ID NO: 241 - protein, 850 aa, Asplenium australasicum
MASFPDYREIYKNVNQVTRAVASRQGSEVMSIHRMYFKLDELEVERLTEADTVKELVVFADVVGIEGQQVKLPASRTVTIVCHILHVKQEAVKLRFDSFGPVDCDRGWLPGIGEAALILSNSPQVRLSIYAQQVVCNTTRAVVQVAHPVTVSQTVSPHNPSRYAIPGTMKWQVEIASDQPDLSAAERSYELRTERFWDVMEKVWRIDQQEWSLFTHLLQGPVSIPPAILGDSNIILGMQSTLLIAELVLSYQTRADDTVSAANAHLQWLITNLLQVLDDNSLDKETREQLLALQARAELASKLPLDGSHTLIVPRLEYGQYQGLIKSMAAVAEAYNSEFMAVNLFIQQNEILGSYLLQQNKAFAARERDMDTFHGLALARKQQELRTAQESMEDLNAQLTQQTEAMDQAKRDMDAGLKKYRDEQVAKAFFSVLKGVLAIGAAIFTGGAAAGPAVNAGVDAVKGVSSLAGKLDMVIDIMERMEKVMEVLNAVNDLVTALSEINKMVEAPEMPSVPSTYEWDIFENEMEEVAESMPTEVTEARTWKTKCKNVAAVCRAICNTASYIGQLQYDVFVQSNQALIAGKQAERLEAIQPADLTNFLEMATQMDMRTSRMLLNLLKVMTIQNAALLFHFLLPPVPFTGWVTVDMVRNALVKHEADALAARERLGPSTDFVQTYVMSDIPISLLLDGDDWIFTIDPADGSTFPLSWSRVRIQYLEMKFTGGEEFHKPTTSSGRVYILLQASRNFQDRLHGDVLHFEAAVPLRYQYAYDLQSGETTVSNRPSQQHDGEYMQMTPFGQWRLRLSASAVENQGLAFPTAVATDLDSSTTQISITFHLTAVRRIDTRALVEL

SEQ ID NO: 242 - protein, 850 aa, Asplenium nidus; identical to SEQ ID NO: 241

SEQ ID NO: 243 - protein, 886 aa, Athyrium filix-femina
MEYSALYGDVNQVSLRFEKTEFSEVVVVHRMHVRLAELNVTLGDNNILLQGSDRVKRLYVLADVVELPPIFSTSMSLPGTVSVVILCRILYLPYLEDASSASGWAVHAALLRLRVVETHAGFAQVFTIPANDSSAAAPADIGLYIHADRIIYRDDPGRSIPVIEVRVGGDSRFSPFLPGSPEIRLSSVQYVREFSKGQPVAPEDSELQRSDEIELIAPSGSEQQLRAAFGASVGMNLLFHFSSSFDILSLDPVPAALLTDPNIITGMQMNMLIAELVLTAAHNSPQLIKVVTRHVEWLNKMFLQLASPNDDILALLFRVQAYQKMAKQPHPVVPRMRYSRYEGLINQMVQIAQSYDQDLKQLKLFVAQNEILGSYLLEQNKAFAAKEKSMSEFHLQVSDLRRSELNDAIQKMTGLGEEMEVEKEAMDQAYKDMEQGLQEYEKRQIVTAVFAVISAISLCALGFVTGGATVAAVPGAVANAAQAVSAAVSLANKLQKVMGILEIINQVVQTAVAIKEVIELFDNMGQLLEAPEMPEMPSNYDWLIFVNEVEAMAEQLPVEVNERIVWKAKCKNVAVLGQEMCTTGSHIADLQYQIKVEEMLREIAQSQAERLEGISSADLSSYTEMVSQIDMRTTRLLFQLIKVLHIQNAALKYEYLYAADEHLVSWPVSMETVWTMLLQQQRLSLLGWENLVGTNNLPNDDTRTYVVKDIPVEVLLSGRDWPFVIHEEDYTAFPSGWYYVRINHVELKFEQQTAGSTDIVIHQPSTNTGRLYMLLQSSRFFHDRNQGVKMEYEGSRGLSYPYAYNLNTGETTHNNIPSDQFKNIFMQMTPFTTWRLRLSASAEENEGLVFHPPPTSPTSTTQVSITFHVTRIRRIDRSTVHQKHVS

SEQ ID NO: 244 - protein, 849 aa, Athyrium filix-femina
PTCQSPEERRGGEATVRIRGRGGNGGPERAASGVEPSHHIVPSPQDKAKWCSDPTVVLEPGGLLGEAPKQRYNGYRARGHCAADRQVLESDAKEWRACSKRPSNTGNTDIEMEDTVLQIDKYWEVTPKSGELAANGRVVTILASHLVAPVGAQLRVQCPVNVEYQTNVIWPPVFSTIAGTVEWRILPYSAVAAAVHSSAAATTSTFAGTAGLIWTVDEVKKWYPSFKIVLPEVIPLQLLANSNIVLGIEVTTLVSELIMTYQRQATETVAATLHHVEWLDAQLLSASQAQSSGQIQALHFRVQSLLKLPMDDDNAPLVVPPLQYEVYDNLINLMTRAAESYDNAFTQLNLFMQQNEILGNFLLEQNKAFSAKERDMESHHSQLVSLQDAELTATSENIKSMNNELAQQNQAMDKAKADMEAGIKQYRDRLIAEAVFGVLTAIAQVCLAVFTGGASAAGAVETARKLSETAKVLQSVVKHLERLQKIAQVINAVTDFLLNLQSLNQLIELPKMPDLPSEADWDMFENEIVAVAESMPTEISEVPMWKAKCKNVAAVGREIIRTVAYMQQLQYDLAVNKMLQDIAQQQAARLEGLHIQDLDNYMEMATELDMRTNRLLMGLLKVLSLQTGALSYHFLLPPRQLNGWLNMDTVWNALLNNEYDAVKALGSLGSAPTDTMKTYVVRDIPVGLLLEGNDWFFDIPVDDPAFPPPWFRIPIEHVELKFPTDSSQCVHLPTTHSGQVYILLQAARFFSDRLKDEVLHFQATKPVSYQYAYRLDSGETTLSNRPTLSSSTHYMRMTPFTRWRLRLSASASQNQGLAFPTAATEDATTQITINFHLTAIHQIQYRAAQ

SEQ ID NO: 245 - protein, 513 aa, Athyrium filix-femina
TGKHHTENGTIEFTNGDTKRRHGPSQRGHGCRYKSFTARLLNLDDHLASLLHTYGRGIHVPSSGLVYTHFNLQLISCRTMICIKHAGLRRFQNRRVAEAMFAVLGATAAIGLAFVTGGATAPAAVTAAGNAVNAAGQAANALRKVVEILEGLQEVMAMVALIKELVDSLQDIGQLVEAPEMPVLPSEADWLIFENNVEEVAEGMPTEVSEVSAWKTRCKNVAVLGRAMVSTAAYISQLQYDIKVEAMRQEIAKRHAERLLAIQPADLSSYTALLTHMDMRNTRMLLALIRVLHIQNAALMYHSLSLPTHMNAWPVTMDTVWRMLVQHEHAAILGLLRLGPSFDFMRTYVVKDIPVSLLRDGEDCEFNISVQDDTAFPSTWSRVRIHHLEMKFVQEAHVHQPSTHTGKVYILLQGSRIFHDRNEDDVLHYEAAMPLDLHYAYRLDTGETTLSNLPSNDFIRTFIRTTPFTTWRLRLSASAEENKGLDFPTALTVDATTQIAITFYVSAIRRISL

SEQ ID NO: 246 - protein, 882 aa, Athyrium filix-femina
LLDPVLSATEVVDYEALYSEVNEIARALWTLKVRCSEVMAINRMFVRLDTLSVEHLQQPEIVKSLIVVADVVEIEGSSSLTLPGSSLILITCRLLRVKQKNAVLNLAWNLAATNANTSTTSLPRCSIYTQQVDVSNGSTLRIQVKRELKWSNGSPFTQYFGREFSYSSSTKNYSTTSAPAAADYSVKSVGQPPESNLILVNSKKMNILMNDIAWKGFIDLQVAMPSLNDLAHPNVIEGIESNLLIVEMILTYQTNVKDLVTAAKDHVEWINKGILEVVDWPNSEVGLQLKALLGRAQMLLKMPSDGSESLIVPQLEYSGYEKVIQEMAKLAESYNTEFRELNALILNSEVIGQNILNQTKILGAKEREVQNLESLIVLRKQKELDQAIERLEILENQLIRQVDEMEAAKKKLDQGLQAYKNEQIAMAFFSVLGTMMQIAGSARLSSIPEIVVGIGGGISEALSAAEKVKDAIVSNTLQDVANKLRNVERVMEVVNSVKDLYTNATNLEDILNAPQIPDVPSSDWEIMRNDMEEVAAGMPTEVSEVSTWQAKSKNVVAVCEEICVTATSISNTQCDLFVHVEQQEIAKRQAERLNQMQAVDLGDYLEMATQLDMCTMRVLICLLKMLGIQNGALQYQYLLAPQPFIGWPTIENVRMEMLRRVELAVLAKVQLGPPVTLTRNYVIESIPVGLLMSGDDWNFSIDASDNSIFPSTWSQVRIRYLEMKFTGEHHPITETGEVYLLLQASSKFEDRLKTQMFQYEAAAPLTYQYAYNLQTGETTLPNLPHEEGTFLRMTPFTRWRLRLSASAYQNQGLSFPTTTSLDNSISISITFHLTAIVQIQTRLAGGSVYNLFDDDDGDDDQQEGGEQAGGKSGGEEEAGSPI

SEQ ID NO: 247 - protein, 821 aa, Athyrium filix-femina
MAAAVDYESIYKNANEIARVVGTDKISCSEVMACHRMFVRLDTLSVEQLVGSSNVKQLIVFADVVEIQDSSFTLPGSTQIFIACRILDVKANKDIDLTLDWQVVNNAGQTSIPRCAIYAQNIVSSSSTKSGTILLKVKYQRSSSSAPVYFGREFSYSAASTAVVDFSTAQDNLELINRKNWVVNINGMEWSAYVDLQFGLPSVEELAEYNILTGLQSTILISEMILNYRTDLPDTVTAAIAHVQWANLCLLPVVGMTNLEGAYQLPSLLGRAQSLLKLPTDGSQSLIVPRLEYSGYEKLIAQMVTVVESYNNEFVQLILFIQQNQIMGAYLLEQNKAFAAKEKDIAELESMILDRKKQEMDNAFQKMEALNKQLEQQVEDMNQAKEDMDVGIQKYKDEQVAKAFFAVIKGILGVALAIATGGATSAGAVAGAVDAVEKVSQLAKALQKVMDILQGLEELAAILSAIKELLESIEDLNKMVEAPEMPEMPTMADWDIFENEIEAVAEQMPEEVAEVPVWKAKCKNVAAVCREISTTAAYIGQLEYDLFLHGKQQEIAEAQAKRLESITPANLTNYLEMATQLDMRTTRLLVGLLKMLTVQNGALQYHYLLPPKPFTGWPTMDRIRSTLVQNEHNAVLALEQLGFSTDFTRTYVLSDVSVYLLLSGEYWIFNIPVDDPTFPSNWSRVRIVYLEINFTGDEGSTHFPSTNTGEVYFLLQASRMFQDRLEGEYLQYEAATPLQYQYAYVLQTGETTVPNKPSQEEDGRFLRMTPFTSWRLRLSASADENKGLSFPSANALDSTTQISITFYLTAIRKINTREGIE

SEQ ID NO: 248 - protein, 882 aa, Blechnum cartilagineum
MEYSTLYGDVNQVSLRFQKTEFSEVMVVHRMYVRLAELDMTTEPYFEMIAGSEKVKRLYLLADVVELPSSALNMRLPATISVIILCRILYIPDINSPYLACGLHFPLMRLRVVETSEGVGRAFPLPSNDGSGAAASIGLYIHAHRFIYRQDTTTGDSIQPLQLRAIGGSTFSTQVRPDWPETLEVSSLICWLSLTKGPRLTPADSDLQRSDEIELLAPASPDKVNIVFAGLAPGNLLSLYLLVDNTSAFSFFPTPVPNVPADVLTDPSIILGMQMNMLIAELVLAAHNSQQVINVVTKHVEWLNKILLQVASPSDDILALLFRVQAFMKMAKQPRSVVPRLQYHMYSSLINRMVQVAQYYDQEFKQLKLFIAQNEILGSYLLEQNKAFAAKEKDMSVFHSQVVSMRRSELNSAVEMMDKLSLQMEKENEAMNEAKDAMVEAIEEYERKQLANALFAVLGAIASVALAFATGGATAPGAVAAAGAAVTAAGKLAAGLQKVVEILEGLQAVMEIVAAIKDLVESLQNMGQLIDAPEMPELPTNADWQIFVNEVEAVAEQIPTEVAEVPVWKAKCKNVAVLGQEMCTTAAHIGELQYQVMVEEMLQEIAQRQADRLEGISPTDLSSYTEMASQIDMRTTRVLLSLIRVLYIQNAAIKYEHLFAASGQLDSWPVSMETVWTMLLQQENAALLGLLDLGPSNDFTVTYVVKDIPVQLLIDGADWNFEIPVGDFTAFPAGWSRVRIRYVELKFVQQGSGEGNIVIHQPSTNTGLVYILLQSSRFFHDRKREEVMDYEASMGLAYAYAYDLVTGATTLSNIPSEEYANTYMRMTPFNNWRLRLSASAMENQGLVFPTATSPDSTTQIAITFYVTAIRRIDTRIDTQRQE

SEQ ID NO: 249 - protein, 865 aa, Blechnum cartilagineum
WPCVGGSRAQPSVSAGENHVMGNASSTDYEHIYRNANNISRMVATPVCSEVMSVARMFVRLRDLDASRLKNPEVVKELYVVADVVDMEEYNDLTLPGSERIYLICRVFTWRRNQPPPTTVRIRTPWLNLSSCSKLEICPLRHDRQAQTSPAFQCFARAKHSTTSEIAPAVLFLHAAHIYTSNPDTDTSHLNVVLQAQESAQYTLMSADQTPSGEEIFWEVETYPLLPRSDLNSTILSAQEANVLVIELILSYITHATETVKQASLHLEWLNKLLNYALNDTSSASTGSLDDEALDRQLHNLSFQVQFLLNQPPTGAGLIVPRLQYYAYSNLVGTMARIAENYDKEFRQFSLFIEQNDVLGTYLLQQNKAFAEKEREMEVFHLELQQVKKDDLTRALAKLERLEVDMREMNAAMEQAERDMEADLVQYRNRQVARAVFSVIGAIAQLGLAFFTGGATAGGAVAGVANAVSQVTDSAALASLRRISETLEKLVLVTEFLVAMRDLLNAVMDIHQGPPEVPTLPEMVSEAEWAIFENEIEAVAAGMPAEVSSVLTWKTKCKNVAALGREMITLATIIVDLQHDIKVHGLMREMAQNHAQRLKALQPVDLKNYQEMATELDMRTTRMLLGLLEVLSLQNAALRYQYLLPPSPVTIESTSLTMSTAWTLLLQHESASVISLADLGFATDQEVAYIVKGIPVGLLLDGEDWDFPISVRDIAEGAAFPADWSRVRISHVEMKFVKPGAAPADEEETVHQPTTNTGKVHMLLRGEQLFADRKRGESLKYEAAVSMEYQYAYRLDTGETTQSNRPSQEFGDKLFMQMTPFTRWKLRLPTAANENRGLAFPTASAENATTQITISFHVSAIRTIF

SEQ ID NO: 250 - protein, 842 aa, Blechnum cartilagineum
SVFCRYQIHLLCVELRFGSCLLAGSIQHLSMGNSIAAAEARNYEEIYKDANHIGTKSLITAVCSEVMTVCRMYVLLDDLDVKVLERAEEVKVLYVVADVVELRGDAVQLPPSVQLILSCRVLLFSSGNGWPQVAILQGPLVHYNGNYSPVTGNWSATPLLEQDTYRFFLHGQQLLILSGTSGRSSGDVLSEDGKKLQLQSSTAPILPPRWVMEDPHILSGLEASVITSELIVGHMTHAVDLVAEVKLHVEWLLLLLRHALNETMTNAEANHLLRSLFFRVQSLVRMATAAQNNTLVVPRLQHHAYSEYINRLAELARSYDTDFKALTLFIQQNEILGSYLLEQNKAFAEKERDMEVVYTTLNDIKMSELIQALGQLERLGEEMGKMSAEMEQAREDMEEGLKIYRNKQVARAAFSLLNAIAQIGLAIFTAGATTGLAASAVANAGQAITQATEAVQQLRRIFETIEKMLLLAEVLVAMRDLITAMNDGGELGTLPEWPEMPTTAEWEIFENEIEAVAAGMPEEVSETLVWKAKCKNVAAIGREMVTQAMLVSQLEYDIKVHSLLQEVAQNQAARLEAIQPTDLIDYQEMAAQLDMRTSRILLSLLQVLALQNGALTYSYLMPRTSLSARSVSATMSAVWGLLLHQGQATLVALGELGSPSTRSVEYVVKGIPVGLLLDGEDWDFTIPVADTLHFPSTWSRVRISHVEMKFVKTGGTAGRDEELQVHQPTTHTGEVYIVLRSELFFQDRRKGQYLKYEATVPVIYHYAYNLATSETTEDNRPDEEFARVFMRMTPFTRWKLRVSTSARENQGLAFPTAITPDATTQIAIRFYLSAIRDFDWNH

SEQ ID NO: 251 - protein, 845 aa, Blechnum cartilagineum
MGNASSTDYEHIYRNANNISRMVATPVCSEVMSVARMFVRLRDLDASRLKNPEVVKELYVVADVVDMEEYNDLTLPGSERIYLICRVFTWRRNQPPPTTVRIRTPWLNLSSCSKLEICPLRHDRQAQTSPAFQCFARAKHSTTSEIAPAVLFLHAAHIYTSNPDTDTSHLNVVLQAQESAQYTLMSADQTPSGEEIFWEVETYPLLPRSDLNSTILSAQEANVLVIELILSYITHATETVKQASLHLEWLNKLLNYALNDTSSASTGSLDDEALDRQLHNLSFQVQFLLNQPPTGAGLIVPRLQYYAYSNLVGTMARIAENYDKEFRQFSLFIEQNDVLGTYLLQQNKAFAEKEREMEVFHLELQQVKKDDLTRALAKLERLEVDMREMNAAMEQAERDMEADLVQYRNRQVARAVFSVIGAIAQLGLAFFTGGATAGGAVAGVANAVSQVTDSAALASLRRISETLEKLVLVTEFLVAMRDLLNAVMDIHQGPPEVPTLPEMVSEAEWAIFENEIEAVAAGMPAEVSSVLTWKTKCKNVAALGREMITLATIIVDLQHDIKVHGLMREMAQNHAQRLKALQPVDLKNYQEMATELDMRTTRMLLGLLEVLSLQNAALRYQYLLPPSPVTIESTSLTMSTAWTLLLQHESASVISLADLGFATDQEVAYIVKGIPVGLLLDGEDWDFPISVRDIAEGAAFPADWSRVRISHVEMKFVKPGAAPADEEETVHQPTTNTGKVHMLLRGEQLFADRKRGESLKYEAAVSMEYQYAYRLDTGETTQSNRPSQEFGDKLFMQMTPFTRWKLRLPTAANENRGLAFPTASAENATTQITISFHVSAIRTIF

SEQ ID NO: 252 - protein, 812 aa, Blechnum cartilagineum
MGNSIAAAEARNYEEIYKDANHIGTKSLITAVCSEVMTVCRMYVLLDDLDVKVLERAEEVKVLYVVADVVELRGDAVQLPPSVQLILSCRVLLFSSGNGWPQVAILQGPLVHYNGNYSPVTGNWSATPLLEQDTYRFFLHGQQLLILSGTSGRSSGDVLSEDGKKLQLQSSTAPILPPRWVMEDPHILSGLEASVITSELIVGHMTHAVDLVAEVKLHVEWLLLLLRHALNETMTNAEANHLLRSLFFRVQSLVRMATAAQNNTLVVPRLQHHAYSEYINRLAELARSYDTDFKALTLFIQQNEILGSYLLEQNKAFAEKERDMEVVYTTLNDIKMSELIQALGQLERLGEEMGKMSAEMEQAREDMEEGLKIYRNKQVARAAFSLLNAIAQIGLAIFTAGATTGLAASAVANAGQAITQATEAVQQLRRIFETIEKMLLLAEVLVAMRDLITAMNDGGELGTLPEWPEMPTTAEWEIFENEIEAVAAGMPEEVSETLVWKAKCKNVAAIGREMVTQAMLVSQLEYDIKVHSLLQEVAQNQAARLEAIQPTDLIDYQEMAAQLDMRTSRILLSLLQVLALQNGALTYSYLMPRTSLSARSVSATMSAVWGLLLHQGQATLVALGELGSPSTRSVEYVVKGIPVGLLLDGEDWDFTIPVADTLHFPSTWSRVRISHVEMKFVKTGGTAGRDEELQVHQPTTHTGEVYIVLRSELFFQDRRKGQYLKYEATVPVIYHYAYNLATSETTEDNRPDEEFARVFMRMTPFTRWKLRVSTSARENQGLAFPTAITPDATTQIAIRFYLSAIRDFDWNH

SEQ ID NO: 253 - protein, 817 aa, Blechnum cartilagineum
MAAGKTVPMYNHDNQSATIWAEGEMVWAERETSDLLCVNWPYILLDDLGVSRISNPSAIRHVVVIADVVEIDQPLVSLPGSLSITLVCRILRVRQAAGAVLQLRHLQAEWATLSQGQSAQLHLYAQQLVGSLEVHQPVMHTIEPEIPETGLPPIGPPFPPIIASSYMIWAISPYTNASQSKPASLTLHGIVVTHSDEWHNRFKVIVPHSPPLEAFEGVDILLAIEAGLAVAETILTFQTHARERVEAARRHAQWLNQLLQELLDSGRSLKEQILGQLFRTQVLLKLPVDRSQTDAVPRLQYERYGSLINRIAREAESYITEFKKMSLVMQQLDQTARGRQLLAMMETFAANESAMEVEETIYLEDAAVLETRRKIWKRQLEKLQAEMEQANQDMNEGLTGYNDRIDANAMFAILKAVASIGLAMFTGGATVEVAVAEAAVAVSLVSGTNAGRLQNAIKTLQVLVGVIEVLVALNSYFSQGQIEQIQNARAMPQLPSEAEWSSFEDDIEAVAATMPKEASEVPTWKAKCKNMAVFCRELTSTASDLALLRSNMRVHDIRKDIAMIYMERLPQMNPAENFKDYAQLVALLDVQNSRILLRLLDMFVLQNGALGYEYLFPVTRLISGWPKVENLSTMLARSEAEAADYLLTEVGQQTNFSATYAVPEIPVGLLQNHDDWIFTIPINGSIVLSDRWSRIRIHNVDIRFRQGALQPSTVDDQLHILLEAAPTFRDRRKQDILDFKAVVPASYTFAYHLRTGETMPTPEVSDQYPLMKMTPFTQWRLRLSDQNHGLAFPTALSPHDTTVISLTLFFSRIVTDW

SEQ ID NO: 254 - protein, 507 aa, Blechnum Gibbum
VCRALISCIQKKIGKTRSLVVPQLQYDVYSSLINRMAQSAESYDQSLRQFKLFIEQNKILGSYLLQQNKAFADKERDMDNFYSELISQIRKVELQSTILRMDQLSLQMQTQSEDMEKAKDDMDKGLRQFQERQVANAMFATIHALASITLAFVTGGATAPGAVAAAGNAVREAGQLARALEKVVGILDGLQVVMEVVSIMKDLVTSLQDLGQLVEAPEMPDLPLQSDWFIFENSIEEVAAEMPTEVSEVTAWKTKCKNVAVLGRKMITTATYISQLQYDIMVQGMLQEISKSHGDRLASIQAADLQSYTAMVTQMDMRTTRMLVALIKVVYMQNAALMYQSLSPPTYVNAWPVTMETVWSILLQHDHAAVLGLMRLGPSFDFMRTYVVKDIPVSLRRDGEDWEFNIPVKDYTSFPSTWSRVRIHHLEMKFVTEGVNGAAHVHQPITDTGSIYVLLQGSRIFHDRNEGEPIDYEANLPSQEFTKTFMRMTPFTNWRLRLSASAEENKG

SEQ ID NO: 255 - protein, 851 aa, Bolbitis cladorrhizans; identical to SEQ ID NO: 97

SEQ ID NO: 256 - protein, 406 aa, Bolbitis cladorrhizans
WCSRCIFFFTGGATAGAAVAQATRAAQSVIKLTTALKKVMDIVEKLQEVMEVISAINTLWNSLQELNNIVEAPKMPELPTEADWDIYENSIEEVAASMPTEVTEVQAWKCKNVAAVSREMTKTAVYVGQLQQMILVTGLQQDIARKQAERLESMQPQDLSNYQEQATLIDMRTSRILLALLDVLILQNGALRYECLLPPEPITGWPTMDDVRRILITQEGLIVNSHTILGPSYNLEVGYNVSGIPVDLLLDNDEFQFTIPISDRVFPLSYFKVRVRYLEIRFVNDSGNHQPTTLTGEVFISLQASRSFKDREKSGGELQYEAAVPKIYQYAYNLSTGQTTFTTEPAAGTENTYMQMTPFASWRIRLSKSAHENEGLKFPTASQGDTTRIFIRFFLTIIRKVERKHQ

SEQ ID NO: 257 - protein, 895 aa, Campyloneurum angustifolium
SSARAAGVFSSMAVATLRAAEYRELYKDLNQVSEGLILEMMEFSEVMVIHRMYLRMVELDVGHLEGAEKVKHLYVFADVVEMAPASSTVRLPGSVSVSIVCRVLWLPVPVSNIPLIAFPHLKLRANFASGSGNRQFNVYRRTDGGSEVDEGLALCIHAVDIQLTGVPAFAVNSPAFYLFTDPRNLTMPAEGAITFGDPDRQVPVLMFRMYAEAQRLSGVNTGIIRISPPFSNNLRIATTVHAPPTVTLLTIDTHHPHGPGFWILRGIPDSLLKSDQLMLLMQMSLLIAELAELAHPSSETRAAVLEHVEWLSGVLIDGASSTEGTQMHQEYLELLFRAQYLLKTTSSSRSLVVPQLQYALYSPLINRMAQVAQIYDDAVNQFKLFIAQNRILGSYLLEQNKASAERERDLEVFHAELISQMTIELNSTLLKMDQLSLQMEAQTADMEQAEREMEEGLRRFRNRQVARAIFSVFRAIAAVALTVVTGGAAAPAAMNAARGAVSVAGQAARGLQSVLEILEGLQVVMEVVAIIKELVESLQDLGKLVEAPDMPEMPTDADWAIFVNEVEAVAAEMPEEVSEVVTWKTKCKNVAAVGRELMTTAAYISRLQYDIKEHSMLQEIAKRHANRLANTQAANLSSYTEMVIQMEMRTMRIIISLVKVVYVQNAALMYQYLSQPTQMRQTWPVSMETVWRMLTQREHASVLGLIRLGPSFDFERIYVVRDIPVSLLLTGEDWEFEIPVSDETTFPSSWTRVRIKHLEMKFVHDDGSAAAGHHQPITDTGKVYILLQSSRVFHDRDQAGREPLSYEAALPLDYQYAYHLDTGETTLSNLPTTQFINTYMTMTPFTNWRLRLSASALENQGLDFPTARQQGAVNQDATTQIAITFHVSAIRQISF

SEQ ID NO: 258 - protein, 764 aa, Campyloneurum angustifolium
MADYATIYANANQIYRRGVVMEGSRVMSVQRPYVLLDELDMQKLKNANVVQNLVVVADVAEIQASQLSLPGTNQVLIFCRILQVRSANRILITVAAQATQVQIGAQITQNLEVKWPDGSNFLNSWPVWRGNVLSGDYGSNNFDLQTFLTGADILLGIQATLLIMETILTFQTQLRETVEAASQYAEWLSTLVPHERFATQEIKDQLIPLVYRSQTLAKMPLDGSQTTVVPRLRYDSYRNLVNALAQTAAQYDNDFKDLERFIQTQQLLDARLLEWNKNFIAKERDMESFHSQVLYLKQDEMKSALDKVDRLGKQHQELTDEMNTAKEEMDKGIRRYQNAQIASAFFDVVAAIGAVVATFFTGGATAGVAVERATKAAQSVISLTTALKKVMEVVEKLQEVMELLSAMKTLWDSVQEINNITEAPKMPELPTEADWDIYENNVEEVAASMPTEVTEVQAWKYKCKNVAAVSREITRTAVYVGQLQHEILMNTMQQEIANKQAARLEAMQPQDLSNYQEQVTLIDMRTSRVLLALLNVLVLQNGALRYECLLPPEALTSWPTMDAVRRILITQEGLIVNSQSSLGPPRDYEVTYNLSSIPVDLILDNDDFQFTIPTSNLTFPMSYFKVRIRYLDIQFVNEIGSHRPTTLGGEVFISLQASRTFQDRDKSAHELQYEAGVPNTYQYAYNISTGITTLSTKPAVGTENVYMQMTPFSRWRLRLNRSAHENNGLKFPTATSQGDTTRIFIKFYLTVIRKIETRAGTLST

SEQ ID NO: 259 - protein, 940 aa, Campyloneurum angustifolium
SSARAAGVFSSMAVATLRAAEYRELYKDLNQVSEGLILEMMEFSEVMVIHRMYLRMVELDVGHLEGAEKVKHLYVFADVVEMAPASSTVRLPGSVSVSIVCRVLWLPVHISDIPLIAFPHLKLRVILPRGPVGVVFNQFAVFRRTDGGSEVDEGLALCIHAVDIQLTGVPAFAVNSPAFYLFTDPRNLTMPAEGAITFGDLDRQVPVLMFRMYAEAFAVNSPAFYLFTDPRNLTMPAEGAITFGDLDRQVPVLMFRMYAEAQRLSGVNTGIIRISPPFSNNLRIATTVHAPPTVTLLTIDTHHPHGPGFWILRGIPDSLLKSDQLMLLMQMSLLIAELAELAHPSSETRAAVLEHVEWLSGVLIDGASSTEGTQMHQEYLELLFRAQYLLKTTSSSRSLVVPQLQYALYSPLINRMAQVAQIYDDAVNQFKLFIAQNRILGSYLLEQNKASAERERDLEVFHAELISQMTIELNSTLLKMDQLSLQMEAQTADMEQAEREMEEGLRRFRNRQVARAIFSVFRAIAAVALTVVTGGAAAPAAMNAARGAVSVAGQAARGLQSVLEILEGLQVVMEVVAIIKELVESLQDLGKLVEAPDMPEMPTDADWAIFVNEVEAVAAEMPEEVSEVVTWKTKCKNVAAVGRELMTTAAYISRLQYDIKEHSMLQEIAKRHANRLANTQAANLSSYTEMVIQMEMRTMRIIISLVKVVYVQNAALMYQYLSQPTQMRQTWPVSMETVWRMLTQREHASVLGLIRLGPSFDFERIYVVRDIPVSLLLTGEDWEFEIPVSDETTFPSSWTRVRIKHLEMKFVHDDGSAAAGHHQPITDTGKVYILLQSSRVFHDRDQAGREPLSYEAALPLDYQYAYHLDTGETTLSNLPTTQFINTMTPFTNWRLRLSASALENQGLDFPTARQQGAVNQDATTQIAITFHVSAIRQISF

SEQ ID NO: 260 - protein, 861 aa, Campyloneurum angustifolium
MASTTKAAGDWRELYRDMHQVSDRMRFDQLEASEVMVIHRMHIKLSELDMGNLEGGEKVKQLYVFADVIEYDHGVPGASRIVRLLGSVSVVLICREWHMSCQLVANVDHYEITGRDDGLRIVLPHMTLHVVSTYSIPGRTNRIDPQSMQEFPEPCFQVYAEDLSMSFYAPAGGNSWDPALRFPGGGHFQAINNVDLVTHNAFVSFLTSAGIVTETTRHSTLRIYQWDQAGLHNMYNRIGSQPPGTRFIVPRYTEARTDVWAGGNRVIARVEVRLLPAYIVLGLRNLVPVQLLINPNILLTMQSSMLIGELVEATNPSAATREIVLKHVKWLNNLFLQVIEEKKGKDVEEYIALSFRAQYVIKRVGRIHGLVVPQLQYDAYSNLINRMAQVAESYDQAIRQFRLFIQNTENNKILGGFLLEQNQAFAEKEKDMDVFYSELIAQRQIELGNTLQKLERLSVQMQQAHADMQQAEADMEAGLRRFQNRQVAKAVFSVLGAIAAVALTIVTAGAAAPVAIGAAKNAVTVAGSAARGLIRVLEILEGLQAVMEVVRIVKDLFDALQELGQAVELPDMPDMPLQSDWLIFVNEVEAVAEGMPVEVSEVVAWKTKCKNVAVLGQEMTTSAAYISQLQYDIMMQDMLQQIARRQAERLSVLQLSDVTNFTEMVVQMDMRTTRLLVALIRVVDIQNAALMYQYLSTPTPVSTWPVSMDSVWRMLLQHEQHAIQGLMRLGPSVDIVRTYEVKGIPVSLLLDGDDYEFELSAEDRTPFPLSLSRVRIHHMEMKFVQGAHVHMPTTGTGTIYILLQGSRNFHDRNEGKIVHYEGATSLDYHYAYHLDTSETIITNMPSAEFVRTFMRMTPFTN

SEQ ID NO: 261 - protein, 424 aa, Campyloneurum angustifolium
FATGGATAPAAVSAAEAAVTAAGKGAKGLQAVVDILESLQEVMEVVSAIKELVESLEQIGQLVDAPEMPDLPSNADWEIFVNEVEAVAEQMPTEVTEVVAWKAKCKNVAALGREMSKMAAHIAQMQYQIRVQELLREIAQKHADRLSSIKPADLTNYLEMVSEMDMRTTRLLLELIRVLNIQNAALQYQYLKTPAPLNAWPVAMSTVWGLLMQQETEAIAGLLELGAASDFTREYVVKDIPVRLLQEGQDWEFEIPVSSADFPSTWCRVRISHVAMQFDAGAAATHVPTTKSGEVYMLLQSSRFFDDRAKRANEFISYQTGMGLFYQYAYRLTTGEATVTNIPSDESANTFLRLTPFTRWRLRLSSSADENIGLAFPTATSADATTQIKITFHVSAVRRRNIFIADLTSNTDQFSLNVKKSCVP

SEQ ID NO: 262 - protein, 557 aa, Colysis wrightii
DGEATAVCTRFVVPRLQYHMYGSLINRMVQVAQNYDQEFKQLKLFIAQNEILGSYLLQQNKAFAEREKEMSAFHSQVVSMRRSELTTAIETMNQLSLQMETESEAMNEAQENMVEAIQEYERKLLARALFSVIGAIASVALAVATGGATAPGAVAAARGAVTAAGRLAQGLQKVVDILQGLQAVMEVVVAIRDIVESLKNMGQLVEAPEMPEMPTDADWLIFVNEVEAVAEQVPTEVAEVPVWKAKCKNVAVLGQAMCTTAAYMSELQYQITVEEMLQEIAQRQADRLVGISAADLSSYTEMASQIDMRTTRILLELIKMLYIQNAAIKYEYLYDANEKLNSWPVSMETVWTMLLRQENAALLGLLNLGPSNDFTVTYAVKDIPVKLLVDGYDWNFEIAVEDFSIFPSGWSRVRIRYVELKFDQQGTDSSNIVIHQPSTNTGLVYMLLQGSRFLHDRKREEVMDYEASMGAVFAYAYDLNTGATTLSNIPSQQHANTFMQMTPFNAAWRLRLSASAMENQGLVFPTATSPDNTTQISITFYVTAIRRIDHRQEGDEE

SEQ ID NO: 263 - protein, 946 aa, Coniogramme japonica
MDAATDHDYDYESDMHDEESPDLEHLARKVEMVDVADDDDESGMTIVHGESTEQLARGTRSVDFGAEDYRDLNQVSERIRLDQMEFSEVMVIHRMFIRMVELDLGHLEGAEKVKRLYVFADVVEVAEGVAWGLWRNGPLARLPGSIAIVIVCRVLWVSGVLASLGNNSMMLQLPHMKLRVLEITPSKLEIHRVDTSTEAADYPALCIHASVLECSNIRLANDRDRPPFPVRLFGFRPDLRDPNLVFSSVPRSVVDHHPINEFYVFSVIRDVFPRLPLPESVSVQLDSATRGANWYSLQTGSISQVGSVSLNRFPAEEEELEPAFSLMKTKIPAAILTDPNILLTIQTSLLIAELVEVTHPSAETGAAVAKHAEWVNELLLQAASEASGTPSHEEYLALLFRSQYLIKVRGRTRSLVVPQLQYDVYSNLINRMAQVAESFDQSLRQVKLFILQNKILGSYLLEQNRALAEKERDMDVFHSELISQSKLELENTIQKMEQLSSQMETQREGMDQAKEDMDAGLRSFQNRRVAEAMFAVISATAAIGLAFVTGGATAPAAVTAAGNAVRAAGQAANALQRVVEILEGLQEVMAMVALIKELVDSLQDIGQLVEAPEMPVLPSEAEWFIFENNVEEVAEGMPTEVSEVSSWKTRCKNVAVLGRAMVSTAAYISQLQYDIKVEAMRQEISKRHSERLLAIQPADLSSYTSLLTHMDMRNTRMLLALIRVLHIQNAALMYHSLSLPTHMNAWPVTMDTVWSMLVQHEHAAILGLLRLGPSFDFMRTYVVKDIPVSLLRDGEDCEFNISVQDHSAFPSTWSRVRIHHLEMKFVQEAHVHQPSTHTGKVYILLQGSRIFHDRNEDDVLHYEAAMPLDLHYAYRLDTGETTLSNLPSNDFIRTFIRTTPFTTWRLRLSASAEENEGLDFPTALTADATTQIAITFYVSAIRRISL

SEQ ID NO: 264 - protein, 1004 aa, Coniogramme japonica
MSGTPARLSLPALIISLSLTLTYRQVPDMDAATDHDYDYESDMHDDLVLRRLKLMHQVPDMDAATDHDYDYESDMHDEESPDLEHLARKVEMVDVADDDDESGMTIVHGESTEQLARGTRSVDFGAEDYRDLNQVSERIRLDQMEFSEVMVIHRMHIKLSELDLGHLEGAEKVKHLYVFADVVEVDEGESGELPVRFPGSMSVFILCRIWHVRAFVGLDGRNHHRVLRLPHMTLHLYRSPTLTRLHRLDPTTLQDVAEPALSIYADVVQVSLQNRPATVHSIAPFYFESSDSRVLLSRPNQQRLLQRTSLFWVRLFRNGIPNPGLPAITNEAFSVRIEDRQVLSGRGPFPTTRYSPAFPRGLLTPDIPVIFLTDSHILPALQTSVLIAELVELGRPSQATIDAVASHLRWLNKLLLKVIQETKGSTEFRQDEYLELSFRAQYLIKKMGNIRSLVVPQLQYSVYSPLINRMAQVAESYDQSLTQFRLFIQQNRILGSFLLEQNRAFAQRERDMDAFHSELISERETELENTLDKMLQLHSQMERESAEMERARERMEEALIDFQRRTILRAVFSIFAAVAGLALAFVTAGAAAPAAVAGASAAVSAVSNTVTVAAALQRIVGMLEILETVMEVVRLIKEIIDNMDLVDQLADAPEMPEMPSDHQWLIFMNDVEAVAAEIPPGVSGVSAWKARCRNVAVLGREMITTAGFISQLQYEIKVQTMLQEIAKRQAERLLAIQLPSLTNFTEMVTQMDMRTTRILVTLIKVVEVQNAALMYQYLSEPTLVNAWPVTMDTLWRILVQHEHSAIRGLIRLGPSFDINRNYVVRGIPVDLLMHGEDWQFEIPVLPNDDDDDEMDAIFPSSWSRVRIHHLEMKFVKAPHVHQPTTRTGSIYILLQGSRIFEDRNQGARVHYEAATSLDYHYAYRLDTGETTLSNFPSMEFTQTFMRMTPFTTWRLRLSASARENAGLTFPTAITADSTDQLIDPDATTEIAITFSISAIRHISF

SEQ ID NO: 265 - protein, 774 aa, Coniogramme japonica
SAVPRCSIHAQQVVVSRTAPPPLLSSIGSLIIRVKRDLQRSDKSPFTQYIVRYFSYSGANTVVTAPVSPTRPPSFHWLQIVSTQRRVTVMFNEIKWNKWKADIDFQVALPLLDDLTDIHVIKGIESTLLIVELILTYRSDRMDTVAAALEHLQWINKSLVEVVQLPNSERVLELKALAARAQMLLKLPIDGSHSLKVPQLQYGQYNDVIDQMAVVAEAYNSEFRALDLFIQGNQIIGDYMLTQMKLMSTKEKDVADLESLMVLRKEQELKDAMERLQFSEEQLLKQVEEMTEAQRQMEQGVMEYVNRLTANAFFAVLGASMNIVGSLMSGSIGGVVGGIGGTISEARDIISMMDDAVASRSLLNVANGLIEVERVFEVVNAIHELYKTASSLEDLLVAEEMPIIPASEWDIMENNMEAVAATMPTDVSEALVWKAKCKNVMAVCREICTSAVTLTELQYDLFVHARKQEIAQRHADRLAEFTAADLSEYMEMASQVDTQNMRVLISLLSMLAVQNGALQYNYLMPPEPFTGWPTVESVRSALVRRKHQAVIRKASMGASHELPAHTYVLQSVPVGLLLSGEDYIFTIDPSGSDFESTWSRVRILHLEIKFTGEHQPRGGPREQAYFLLQPSSHFQDRWGNQVFHYEAVVPLIYQYAYNLNTGQTTLPNIPHEEATFLRMTPFTRWRLRLSASASQNQGISFPTATAPDSTTQITITFYVSAHVRPQTFNPLDHAEEPDIPWGEDQQQRSTEPEHEEPERGEEQEQPDIIPQEPV

SEQ ID NO: 266 - protein, 641 aa, Coniogramme japonica
SAVPRCSIHAQQVVVSRTAPPPLLSSIGSLIIRVKRDLQRSDKSPFTQYIVRYFSYSGANTVVTAPVSPTRPPSFHWLQIVSTQRRVTVMFNEIKWKADIDFQVALPLLDDLTDIHVIKGIESTLLIVELILTYRSDRMDTVAAALEHLQWINKSLVEVVQLPNSERVLELKALAARAQMLLKLPIDGSHSLKVPQLQYGQYNDVIDQMAVVAEAYNSEFRALDLFIQGNQIIGDYMLTQMKLMSTKEKDVADLESLMVLRKEQELKDAMERLQFSEEQLLKQVEEMTEAQRQMEQGVMEYVNRLTANAFFAVLGASMNIVGSLMSGSIGGVVGGIGGTISEARDIISMMDDAVASRSLLNVANGLIEVERVFEVVNAIHELYKTASSLEDLLVAEEMPIIPASEWDIMENNMEAVAATMPTDVSEALVWKAKCKNVIAVCRELCSTAVSMSELQYDLFVHASMQEIAQRQAERLEEFRASDLGEVTEMATQVDMQTMRVLLSLLSTLAIQNGALQYNYLMVSEPFTGWPTVENVRSSLVRRQQQAIWDRPPSCRPTRTCWSRYRWACFSLGRITCLLSTQAALISRIPGLASASSTLRSSSLEDTCHAQLATKPISYCKRRPNSRIDGGRRSSITRQLLP

SEQ ID NO: 267 - protein, 882 aa, Davallia fejeensis
MEYSSLYGDVNQVSLRFQKTEFSEDMVVHRMHVRLEELDISVGPFNNETIEGSENVKRLYVLADVVELPSTPRNTRLPATISAIILCRVLYIPDIRFAHPTTCGLDFPFMRLRVVETSQGVGQAFALPSDDDGTGSTGAAASNIGLYILADRFIYRQATSTANFVQPLRLMTYGTSSFSTTVRPDWPEALNISPLTYWLTLSKGPPLTSSDSDLQRSDEIELLARPPPPDRIQVVFRPLAPGNMGGMALLLENSSSAFSFFPAPAPAVSADVLTDPSIILGMQLNMLIAELVLAAHNSPQVIKVVTKHVEWLNKILLQVASPSDDILALLFRVQAFMKMAKRPRFVVPRLQYHMYSSLINRMVQVAQSYDQEFRQLRLFIAQNEILGSYLLEQNKAFAEKEKEMSVFHSQVVSMRRSELNSTIEVMDRLSSQMESESEAMDKAKDNMVEAIQEYERKQLANALFAVLGAIASVALAFATGGATAPAAVAAAGAAVNAAGRLAQGLQKVVEILEGLQAVMEIVAAIRDLVESLENMGQLVAAPEMPEMPTNADWLIFVNEVEAVAEQIPTEVTEVSVWKAKCKNVAVLGQEMCTTAAHISELQYQITVDQADRLVGISIADLSSYTEMASQIDMRTTRMLLELIKMLYIQNAAIRFEYLYAASEQLNSWPVSMQSVWTMLLQQESASLLGLLDLGPSNDFTVTYVVKDIPVKLLVDGYDWHFEIPVDDFASFPAGWSRVRIRYVELTFDQQGTDQSNIVIHQPSTNTGLVYMLLQGSRFLHDRKRGELMHYEASMGLSYAYAYDLNTGATTLTNIPSEAHANTFMQTTPFTAWRLRLSASAMENQGLVFPTATSPDDTTQISITFYVTAIRRIDTRQSGDHVE

SEQ ID NO: 268 - protein, 855 aa, Davallia fejeensis
MERAIPDYSHMYRELNQVSERMKIEEMELSEVMVIHRMFIKLPDLSIAHLEGADKVKRLYVFADVVEFGSVGQTSSLPGSIMVVIMCRVLTWHWADALATPYQLDFPHMRLHAIVRSENGPLLHYHRRNSDSVHDDYPVITVSAHVIQFSGSRPTHFFGIGPLRDPSMIISSVVHQPNIVERPSRGSFCNVGLSSGSSIVTNPGRVQFRIILNWDVDRSYTVTRAPQGFSLLQRDLPDLLLIDPNILLCMQTSMLVAELVEFSHPSSDLHAAVSEHVAWLNTHLLQASTKAQGTSSHDDYLALIFLAQYLLKGMGRARSFVVPQLQYDVYRNLINQMARVAESYDQSLRQLQLFVAQNKILGRYLLEQNRAFAAKERDMEVFHSELIANKELELQNTMFKMEQLSLQMETQIADMDQAREDMDAGLRRFRNRQVANAMFAVFRAIGAIALTVVTAGAAAPAAMAAAKGAVTIAGQAARGLVRVLEILDNLQAAMEVFKIIKDLVESLREVGQLVDAPDMPDMPTEADWSIFVNEIEGVAEEMPEEVSEVSAWKTSCKNVAAVGRELMTTSAYISQLQYDIKVQALLQDIANRQAERLSSIQAADLSSFTEMVTQMDMRTTRILIELIKVLDMQNAALMYQSLTPPAPMNAWPVTMETVWGMLVQHEHAAVFGLMRLGPAFDFKRTFIVKEIPVDLLLHGEDWQFEIPVNELTVFPSTWSQVRIHHLEMKFVGTHDIEGAHQPTSESGEVYILLQGSRVFHDRNKSEPLHYEAAVPLDYHYAYHLETGETTLSNSPSNDFIRTFMRMTPFTTWRLRVSASAKENQGLAFPTTTVGAGDTTQIAVTFYVSAIREISL

SEQ ID NO: 269 - protein, 867 aa, Davallia fejeensis
MELIEKERTNKMVYTSAMVDYERLYREVNQTARAVGINKVRCGEMMAIHRMFVKLDSLTVENLDQYEVVKGLVVIADVVEIEGSSELTLPGSEYVLIFCRILHVKTDKEVVLNLNWKLSHNPPPSPSPRCSFYAQEIVASPNATLLIQVKHNDKWSNDSTFTQCIGRRFSYSSTNSSISSTPPSNVSSLGNPPTSNLILVEFERMNILYNDTNWRAFIRFQVSIPSSYDLLFPNVVEGFESTLLIVEMILSYQTDNRDLVHAAQQHLHWVDKLLLEVVSFGGDAHVQTQNKALLSRAQMLLKMPLDGSQSLVVPQLEYTGYEQVIRDMANMADAYNREFQALNQFIISNQITGQYMLNQNKALAERENDIQALESLIVLRKEQELDQAMRRLELLENNVRRQANEMDAAKDRLDQAIQDASHKRFATAYFALLGATFQIVGSLNVSNVPGIVVGIGGGINDLVNAANEVNDLTQRNMLRDVANKLGNVERVVEVVNAVQDLYKNATSLEDILNAPEMPIILASEWDSMENDVVELAAFMPTEVSIEVSTWTAKCKNVMSTSREICTTAVSISQIQCDLFVHAKQLEIAQRHAERLEEMQAVDLGDFLEMAMQMDMRTTRFLINLFRKLAIQNGALQYHYLLPPRPFTSWPTIDNVRRELVLRAEMSVLAQEQLGPPIRLTRTYAVHSIPVGLLLSGDDWNFLIDPSDDSTFPSNWSQVRIRYLEMEVTGEHKPITQSGEVYLLLQASSMFQDRLRGQIFHYEAAAPLSYAYAYNLATGETTLPNQPHEEGRFLRMTPFTRWRLRLSATAPENQGLSFPTATDLASSTQISITFYVTAIVGIHNLSSTVLSLLDYNEHGEEDHEEAKV

SEQ ID NO: 270 - protein, 340 aa, Didymochlaena truncatula
MPTEADWAIFVNEIEGVAAGMPEEVSEVSAWTTKCKNVAVLGRELTTTAAYISRLQYDITEHAMLQEIAQRHANRLSTIQAADLSSYMEMVMQMEMRTTRIMVSLIKVISIQNAALMYQCLAPPKELVRQWPLRMETIWTMLMQNEHVAILGLIRLGPSFDFKRTYVVRDIPVSLLLAGEDWEFEIPVSDHTTIPSTWSRVRIQHLEMKFVDDDATGAHQPITDTGKVYILLQGSRAFHDRSQLGLLPLLYEAALPLDYHYAYRLHTGETTLSNLPSTNFMDTFMRMTPFTNWRLRLSASAEENQGLDFPTARQQGTINEAATTQIAITFHVSAIRQISF

SEQ ID NO: 271 - protein, 863 aa, Dryopteris erythrosora
MEYSDLYGDVNQVSLRFQNTEFSEVMVVHRMHVRLDELHIPLTALEGSKKVKRLYVLADVVELPSSRPSLLLDLPATISVIILCRVLYAPATLTFLNFSFLQLRLRVVETSEGVAQTFAVPSEDDGDGSNIGVYIHADRLISRQLDTTTNNRLLLVMEVVGAGSTFSSTVRPNWPDTINVSVLGWELLLSRGPALTPSDSDLQRSDEIELLANPPHFPSELHGSVRFESWNPAVNTMHLFLQFQNSSTFSFFPVPAPPHVPADVLTHPSIILGMQMNMLIAELVLAAHNSPPVVNVVTKHVEWLNKILLQVASPTDDILALLFRVQAFMKMAKQPRFVVPRLQYHMYSSLINRMVQVAQNYDQEFRQLRLFIAQNEILGSFLLEQNRAFAEKEKEMSVFYSQVVSMRRSELNSGIETMDRLSLQMGTESEAMDEAKDDMVEAIQEYERKQLANALFAVLGAIASVALAFATGGATAPGALAQGLQKVVEILEGLQAVMEIVAAIRDLVESLENMGQLVAAPEMPEMPTNADWLIFVNEVEAVAEQIPTEVTEVSVWKAKCKNVAVLGQEMCTTAAHISELQYQITVEEMLQEIAQRQADRLVGISIADLSSYTEMASQIDMRTTRMLLELIKMLYIQNAAIKYEHLFAASGQLNSWPVSMQTVWSMLLQQESAALLGLLDLGPSNDFIVPHVVKDIPVKLLVDGNDWHFEIPVEDFAIFPAGWSRVRIRYVELKFEQQGTIHQPSTNTGLVYMLLQGSRFLHDRKREEVMEYEASMGVSYAYAYDLRTGATTLTNIPSEASANTFMQMTPFTAWRLRLSASAMENQGLVFPTATSPDDTTQISITFYVTAIRRIDTRQQGDVE

SEQ ID NO: 272 - protein, 818 aa, Elaphoglossum
RLLKSNRTSTCCAPTGVWELLTCWRQSILSMAKDYAEIYKGTSQLDRSVATPVCSEVMTVARMYLLLDDLDVSLLKQPEVVKTLYVFADVIEMKKRVTLPGLEAFIVCRVFLTFTTTEETRSIWPELQTGVIVCRVFLTFNTTETRSIWPDLETDGPGWVPPDPSDPRPPAEPAPVQVPVYPILTDGTILHPLTAANAVPRSTLENSNMLLAMQATLLISEVILSFMTHATDLFTEATLHVEFLNNLLVKGMEDTTSGSGEEGRHQLRTLLFRVESLLKMQAPGLLVPRLHYNSYRNLINRMADMAMSYDTEFKQLNLYIQQNEVLGTYLLEQNKALAEKEKEMEEVHSELQEYKTTELRDVLATLDRLGGQMSEMSAEMDQAQEDMEKGLIVYQNRQTARAVFSVLNAIAQIGLAFLTGGATAPLAVNAAANAAQSASKLLKVVETLERLLLTVELLVALRDLFDAINNLGSEMTGTPIKPEDMPSAAEWTIFENEIEAVAAEMPVEVSEVLAWKAKCKNMAALGRELVNQTALVSQLQYEINLHSLQREVAQNHADRLLAIQPVDLSNYQEMAIQLEMRTTRILLGLLQVLLLQNGAIHHYYLQAPTPLSSTSVTMTAVRTLLVRQEATAVISLAELGTPSDRNFTYSVKGIPTKVLLDGEDWDFAVPVTDRDVFASDWNRVRILHVELKFVTADSGEVHLPTTDTGEVYMLLRSERFFEDRKNDELLQYEATLPVQYQYAYNLKTGETTEDNRPSEAFANLFMQITPFTRWKLRLSASASENRGLAFPTAVAADATTQIDIRFFVSAIRRIDWKM

SEQ ID NO: 273 - protein, 788 aa, Elaphoglossum
MAKDYAEIYKGTSQLDRSVATPVCSEVMTVARMYLLLDDLDVSLLKQPEVVKTLYVFADVIEMKKRVTLPGLEAFIVCRVFLTFTTTEETRSIWPELQTGVIVCRVFLTFNTTETRSIWPDLETDGPGWVPPDPSDPRPPAEPAPVQVPVYPILTDGTILHPLTAANAVPRSTLENSNMLLAMQATLLISEVILSFMTHATDLFTEATLHVEFLNNLLVKGMEDTTSGSGEEGRHQLRTLLFRVESLLKMQAPGLLVPRLHYNSYRNLINRMADMAMSYDTEFKQLNLYIQQNEVLGTYLLEQNKALAEKEKEMEEVHSELQEYKTTELRDVLATLDRLGGQMSEMSAEMDQAQEDMEKGLIVYQNRQTARAVFSVLNAIAQIGLAFLTGGATAPLAVNAAANAAQSASKLLKVVETLERLLLTVELLVALRDLFDAINNLGSEMTGTPIKPEDMPSAAEWTIFENEIEAVAAEMPVEVSEVLAWKAKCKNMAALGRELVNQTALVSQLQYEINLHSLQREVAQNHADRLLAIQPVDLSNYQEMAIQLEMRTTRILLGLLQVLLLQNGAIHHYYLQAPTPLSSTSVTMTAVRTLLVRQEATAVISLAELGTPSDRNFTYSVKGIPTKVLLDGEDWDFAVPVTDRDVFASDWNRVRILHVELKFVTADSGEVHLPTTDTGEVYMLLRSERFFEDRKNDELLQYEATLPVQYQYAYNLKTGETTEDNRPSEAFANLFMQITPFTRWKLRLSASASENRGLAFPTAVAADATTQIDIRFFVSAIRRIDWKM

SEQ ID NO: 274 - protein, 591 aa, Elaphoglossum
DNRDIAWKHLHSWPEYSCRCSTSMPLAVKTTGTSPGNICILGLSTAAIVPESAVAVITDANILLGMQVTVLIAELVKTAHNSDIVIDAITRHVEWLNHLLVQAHSTAPSEDVVALLYRTQGVLKMPREGLVVPRLQYHMYKNLIDRMVQVARSYDQDFRQLRLFVEQNRILGSYLLEQNRAFAAKEQDMDAFHTQVIALRTTELNNTIETMDLLSIQMEAENEAMEQARADMEAGLVQYQNRQVANALFSVLTAIASIALAFATGGATAPGAVSAAGAAVTAAGQAAAGLRRVVEILEGLQVVMEVVAAIKELVQSLQEIGNLVDAPAMPDLPVMEVVATIKELVQSLQEIGNLVDAPAMPDLPSNADWDIFVNEVEAVAEQMPTEVSEVPAWKAKCKNVAALGREMSTMAAHIAELQFEIQVQEMLRDIAQKQAERLLSIQPADLTNYLEMVSQMDMRTTRMVMELVRVLRIQNAALQYEYLQTPAPLNAWPVTMETVWGLLIQQETAAILGLLQLGPPSDFRREFEVKDIPVSLLLEGQDWEFELPVMNADFPTTWCRVRIDHVEMHFDSAAAHLPTTNTGKVYMLHCQ

SEQ ID NO: 275 - protein, 1344 aa, Polystichum polyblepharum
MGDEGDVKEDEYDYEAAYKEIDDCIRKDECFGRVENCGGLWGQTMVVRSMYLRLDDIDARHVVRPETVETLLVYADVVDVESDWVDLPGTKLVFIHCRLMRLKSRGGSTTVHFKYMMATAREGSPITYLYPHQLIVAGGDQASGLILRVSYRIQVLKKQVELVRTCHLNTFKSITVQTLKTPGFTYNSDESDFEAARTRIDLFEADYSFSEDLCNKIRYLLTTSLSSLQNTLPKICVIPPVACLHLEWLTHDCVLLWLLIREQNLKNLREKKNLVITPELKNSLLITIIKLSRMGEVAFTELVREGLIDDKHKGDLKFIFQTMHNLHRILKIQRTRTIGEVANYDEVFNSVNQIKEVVATRECSEVMVIQQMYLLLDDINVGLLQNPHNVKKLVVFADVIEIRSQNLHIPSSREVIIICRILRTKRANKLTFPYLSYNSYPLSLYVSPFGLLQQDSTSKVCIYTKELIMNDPANLLRVYSTSMELPNLVEVLGDPYVLPLIVDSLQSVENIMTYLKRTTVIATIVQDHLQWLISLLNQMMFAKSGNINITGLWRQWAENLSSHIEDATQHTLSTSEVVDYAEVYKNVNADYTELYKSVNQMRRVFVGGECPEVVIVHRMYLRLDELAASLFKKPYAIKELYVYADVVELGSQNLQIPGSTKIIIICRILRVKGPHKLTFPYLSHDPNSLPLSLFVSMINLMDWTSTLGVCIYAQHLIMNNPFNPTKCSSTSFELSIPVLIQLGNPNVLPLIEGDLQSAELILTNQTSVTATVTATKDHLQWLITILNEAKDITNLSKVSFRDLLNHAQSILRKSNESSILLVPSLRYDKYSDLIKTMANAALDYDNEFKQLDLFNKQIQISGDYLWVQNKKLAEKERDVALFHLSLLEHKKKELNAAKENSSKLKEQLKSLKKELVKAQQDLDAGLKRYRDELKMKAILSVTFLVINLALVFSTFGGNINGYKEVQESIEECKSTKKILVETWKVIKTLQEVALCLGENIGNSTKRKLHDTFDMPKMPSKADWYKFENEIVEMVENLPSKMSEVFAWKAKCKNVAIVSRELITTMAYIRRLEQEIWVEDREVEIATKQAERLEKMKVVGLNNYEDMVFQLDIRTMRILTQLLRVLNLQNGALLYHYLLQPKPIVKRWMNMGEVTSALRSHKELEIEGLEQMGTPTDKESVYKVCNIPVDLLMDGQDWIFTIPTDDFLVFPRSWSHVRIKYVEIRFSPTHHIPSTTSGQVYFLLQASRMFQDRKKEQVLDYEAAVPLEYQFAYDLKSSKTTESNKPTHEYEGSFMRMTPFTQWRLRLSSSAEENQGMSFPTAKEPDSTTEISITFYLTSIREKST

SEQ ID NO: 276 - protein, 1031 aa, Cyrtomium falcatum
MCVQEVIFDTMHNLHRILKIERTRTIGEVENYDEVFNSMNQVREVVSTTECSEVMVVQQMYLLLDDLNVGLLQNPHKVKKLIVFADVIEIGSQNLHIPSSAKVTIICRILRTKRPKKLNFPYLCHNSSPLSLYVSPFGLLQQGSTSKVCIYTKELIMNDPFNPLRVYSTSMELPNLVEVLGDPYVLPLIVDSLQSIYYILTCQKSTAIIATTTQDHLQWLISLLNQMFAKSGNNIIDFWRQWAEYLSKHIEDVTQHTLITSRMVDYAQVYKNVNADYAEVYKSVNQMRRVVAMQGRECPEVVTMHRMYFLLDELNASLFKNPDAIKELYVYADVVELGSQNLQIPGSTQIIIICRILRVKGPHKLTFPYLSHDHDISPLSLFVSTVTLFDWPSTLGVCIYAQHLIMNNPFNPFTFASTCFQLSIPAELLGNSNVLPLIEADLQSAELILTYQTSVTTTITATKDHLQWLITLLTKVKDDADLNEVSFQDLLNHAQSILRKSYGSTTLLVPSLRYDKYSDLIKTMANAASAYDSEFKQLDLFNKQIQIAGDYLWVQNKKLAEKERDVTLFHSSLLEHKKKELNAANENSEKLKKQLESLKTELMEAQQDLDAGLKRYKDDLKMKSILSMVFLVINLALVFTTFGANINGYKEVQESIEGCKEIKKVLVETWKVIKTLHELTLCLFEKIGTSTKRKFHDAFDMSKLPSIADWYKFENEIVAVVENLPSKVSEVFVWKAKYKNVAVVSRELITTMAYIRRLEHEIWVEGREVEIARKQAERLEKMKVVGLKNHEEMALQLDMQTMRILTHLIRVLNLQNGALLYHYLLQPRPIVERWVNMGEVTSALRSHKELELEGLEQMGTPTDKESVYKVGNIPVDLLTTGQDWIFTIPIDDFSAFPQSWSHVRIKYVEIRFSPTHHIPCTTSGQVYFLLQASRMFKDRKKGAVLDYEAAIPLEYQFAYDLKSGKTTESNKPTHEYEGSFMRMTPFTQWRLRLSTSAEENQGLSFPTSKETDSTTEISITFYLTSIREKST

SEQ ID NO: 277 - protein, 1348 aa, Matteuccia struthiopteris
MGDKYVGDKEEEYDYEAAYKEIDDCLRKDESYGRVENYGGLWGETMVVRSMYLRLDDIDARHLVSPERVKTLLVYADVVDVESQWVDLPGTCILIVCRLMRMKARGGSTTLNFKYVMASGSDGHVFTGGLFPPQQLIVAGRGEASGQEQQLVVRYSFRIQVLRKEVDVVRTILWTPYTDITSLRTTRQTLKKPGFTYKSDESDFEEAQTRVELLASEAKGEDLSEVCTLGHDLSKSTCNKVRFLLRTSLSSLQNALPKICVIPPAACLHLEWLTHDCLVLWALIRDQSDRQELRGMQSLIHIATLMRNMGGLGAFTGLIGYKHKPDLKVIFETMHNLHRILKIERTRIIGEVANYDEVFNSMNQIREVVATSEVMVMQRMYLLLDDLNVGILQKTKNVQTLVIFADVIEIGSQNVQIPGSTKVTIICRILRSKRPKMITFPYLCHNSSPLSLYVSPFGLLQQDSTSKVCIYAKELIMNDPFNPLRVYSTSVELSNHVEVLGNPDVLPLIVKSLQSVDYILTYQKSTTIIATTTQDHLQWLISLLNQVMSAKIGNSVIDFWRQWAEDRSKYIEDVAEHTLSTSKVVDYAEVYKTVNADYAEVYRSVNQMRTVVFNTDIECSEVMIVHRMYFLLDELNASLFKSPDVVKELYVYADVVELGSQNLQIPGSTKIIIICRLLRVKGPRTITFPYLSHDHDLSPLSLFVSIVNWPSTLGVCIYAQHLIMNNPFNPTTCSSTSFQLPIPVEILSNPNVLPLIEADLQSAELILTYQTSVTETITATKDHLQWLITILNEAKDHTNINEVSFRDLLNHAQSIFRKSNGSTILLVPSLRYDKYSDLIKSMANAASAYDSEFKQLDLSNKQIQIVGDYLWVQNKKLAEKERDVARFHSSLLEDKNKELNAANENSEKLKEQLESLKIELMKAQQDLDAGLERHKDKLKMKAIQSVVFLLINLALAFTTLGVDIKAYAEVQKSLKKYKDTKKILEDTWSLINMVARSLCVCEKIETSTKIQLHDTFDMSKMPSKAHWYKFENEIVAVVENLPSEVSEVFVWKAKCKNVAVLSRELITTMAYIRQLEHEIWVEKREVEIARKQAKRLEKMKVVGLKNYEEMALQLDMRTMRILTHLLRLLSLQNGALLYHYLLQPRPIVETWMRMCEVTSALRSHKELELEGLQEMGAPTDKESVYKVGNIPVALLMTGQDWIFTIPTDDFKVFPRSWSHVRIKYVEIRFSPEHHTPSTTSGQVYFLLQASRMFQDRKKGQVLDYEAAVPLEYQFAYDLKSGRTTESNKPSHEYEGSFMRMTPFTQWRLRLSTSAEENRGLSFSTAKETDNTTEISITFYLTAIREKNT

SEQ ID NO: 278 - protein, 1082 aa, Thelypteris noveboracensis
MGENVEDNEYHYDYEAAYKEIDDLISTVVKRECSEEIMVVHCMYLRLDDVDAGHLVNPEKVKIMLVYADVVDVESEWLEFSGRFEVYIMCRMLRVKARHGSTLDFKYFTPIGASMKTLQLPAWTMNEQLHIWAQQLMGGENEQELAIRAGFWAYEENTRVQVVGELRVKPYGRECTEDESVTRTCQTLQKPGFTYRPDESDFQEAQSEVNDLLCNRPRWFKECFHLVSPEPIAISWSDELCETIEGALSSLELALSRACIIPSAAFLHLQWLVRHLAQMGSTATMSSIASANINCLESLLSRAKTLLNAITYLQAHTRIIGEVVYAEVYKNMRRAFSTRECSEVMTMQRMYFLLDDLDMGLFKNPHVVKELIVYADIVEVGSNTLWIPGSTRVIIMCRLLSLKRSQPCILNFPHMPHDDASSYLSVYVSPAMLLNQPPATLGVYIYAQELIISNPINPTTCFSTSFQSSIPVEILGDCNVLPLIQGALHTLTYQLSATANVKTTQDHIQWLIIHLAQVENKANLHESSLNDMRDLLLHAQLLLKMSSESKSVIVPSLRYEKYSKLIERMATAASDYNSQFLQVDYFIRQNQISGDYLLQQNKIFMEKERDVEYFHSLLTDCKKVEFDAAMHKMKALKELLTTQEVEMNQAKKDMEAGLKRYQDSKIADAVFSLFGAVFEVGLAASALANAGTTLRRFKDVVEKMKKLKDTLEEIVKMVKMVENICSSFDALMDVYTLDFQKPQQIGKSLMPEMPKMPSKADWEIFENELMQVAESMPSEVSEVPIWKAKCKNVAAVFRELITIVSYMKQLEFDILVEGMEGKIAAKQMERLEHMTLADLKNYEDMAMQLEMRTSRILSRLLKALNVQSGALLYHYLLRPKPITNWMDMDAVTNALLSYEELAVEGLEQLGTPTDYRREYVVADIPVALLMDGQDWTFTIPIDDYLVFPAYWSAVRIKYVEMRFDEGHHLPSTNSGQVYCLLQASRMFQDRKRGEVLDYEAAIPLDYQFAYQLETGCPTVTNKPTHEYMGTFMRMTPFTQWRLRLSASARENHGLTFSTAREANSTTQISITFYLTAIREKSL

SEQ ID NO: 279 - protein, 874 aa, Pteris cretica
MFTQDDDWCVYMYCSPGILDMAGRDHNTDVINYEEIYKAVDEVRRTVVPRSKDAVMIVEGMYVNLNSRIDDGLFTGDSSKPKEVWVVADVVALSNDVKVPTSTERLVILCRILHVDGSYARLFSASQNVILDCDYIQESEAISKSWKVRSTELQIHIYAQCLQAPSSKELMPLCVSIPAHRKYPFFIYVMWGLFGMFDSGRGRMMPALSFPRHENNFLGPLFRSREELEQLERLFVVSLCDEQIPAALLSEAAIVEAMQATLLKAELILTYQTQAHGGATAEMARQHVEWLRSQLKGCISSQQEGQVQLDAGLAALLVRAESLSKMPQRTAYNVVPSLTYKAYRDLINRLATAAKDYDNSFMQMRTLVQSSQMTDSDFETLYKALAQKEKDVDEYHQQLARLKQNELKEVSSSLDVLKCELEKQKQAMDEAEQDANDRLKEYEMKQAAKAVFEVVKAVFAMGAAVFTAGTTVGVALEGVEEAVNASGKMKQALELLEKINKLLKVMAAIQKLIDSLNHLKDVIEAPELPSMPTEADWDIFENEIMAVASQLEKAINVANWEAKCKNVAAVGKEFIKTANRMGQLQYEILVQNLQGEVARRHRERLEEIISKGRDYDKYEEIARHVEMLRSNLHIRLLHILDLQRAAVYYHFLLDQTPFTVWVDVDTVTATLIDNEAVILTNLDSLSKCSDKTITYSVEGIPVSLLESGGAWVFSIAVPGSDQSGHKGFKDLSRVRIEYMTIKFAANSAKPQTHDDDDTDDDTVLFLMQAATDFQDRRKADKKVLQYEAAVPLRYRYAYNFSTEEELVDNRPSTSGGVEDFWMRMTPFTTWRLSLPISDPYNEGLKFDDSSASTTTSIRIVFHVSAIRDESYLFR

SEQ ID NO: 280 - protein, 819 aa, Cyrtomium fortunei
KLWKSRKVLGGGGGMVVRSMYLRLDDIDARHLVSPERVENLLVFADVVDVESDWVELPGTKTVLMVCRLMRLKARGGGSTTLDCRLRLATDQVDAGGGVYPPQQLIVAGEASGLLVRCSYRIQVLEKEVDVVRTCHLSPYTDVMAGLIVTMQTLKTPGFTYNCDESDFEAAQTRVVVLEERAMPERTCNSVCFLLRTSLSSLQNALPKICVIPHPAARLHLEWVTHSCLPLWLLIRGQYLHEKKDLVITNELQAQILTYIVKLIRMGEVAFTKLVQEGLIGYKLKGDLKVIFETMHNLHRILKIERTRTIGEVANYDEVFNSMNQVREVVSTTECSELMVVQQMYLLLDDLNVRLLQNPHKVKKLVVFADVIEIDSQNLQIPSSAKVTIICRILRTKRPKKLNFPYLYHNSSPLSLYVSPFGLLQQGSISKVCIYTKELIMNDPFNPLGVYSTSVELPNLVEVLYVLPLIIDSLQSIYYILTCQKSTAIISTTTQDHLQWLISLLNQMFAKSGNNIIDFWRQWAEDLSNHIEDVTQHTLSTSEVVDYAQVYKNVNAHYAEVYKSVNQMRRIVATQGRECLEVVTMHRMYFLLDELNASLFKNPDAIKELYVYADVVELGSQNLQIPGSTKIIIICRILRVKGPHKLTFPYLSHDRDISPLSLFVSTVRLFDWPSTLGVCIYAQHLIMNNPFNPTTCASTCFQLSIPVELLGNPNVLPLIEADLQSAELILTYQTSVTTTITATKDHLQWLITLLTEVKDDANLNEVSFRDLLNHAQSILRKSNGSTTLLVPSLRYDKYSDLIKTMANAASAYDSEFKQL

SEQ ID NO: 281 - protein, 616 aa, Colysis wrightii
RAYSANRVRPKFPLHHLSHVFLYLVYVNLNLRIVEGLFLNRGGSKPRKVWVVADMVALSNDVMVPTSTERLVILCCILHVDGSFARLFSNSQAVAVLNQNHGEVSFYNSCKVLSTELQIHIYAQCLQAPSSKELMLLCISIPVHRGSPFALNVTWGHFGMFDSHRSRMMPVLSFQYNDAKNFVGPLFRSREELEELERLFVVLLCDEQIPAALLGKAAIVEAMQATLLKAELILTYQTQAHGGATAKMARQHVKWLRSQLKGCISSQQEGQVLDAGLAALLVRAESLSKMSEQIAYNVIPSLTVIPSLTYKAYRNLINKMATTAKDYDNSFMQMWTLVQSSQMTDSDFETLYKALTQKETDVDEYHQQLARLKQKELKEVSSRLDVLKRELNKQKQAMDEAEQDANDRLKEYEMKQAAKVVFGVLMAVFAIGAAVFTAGATVGVAMKSVEEAVNASGKLKQAFELLKNTNMLLKVMAAIQKLMDSLDHLKDVIEAPVLQSMPTEADWDIFENEIMAMASQLEKAINVANWKAKCKNVAVVGKEIIRTADCMGQLQYEVLVQDLQGGVARRHKKRLEEIVSKGRDYGKYEEIARHFEMLRSNLHIRLLHILDLQRLY

SEQ ID NO: 282 - protein, 580 aa, Blechnum occidentale
LNWVSCLSSTSVDGEVSKDLGALLFRVQALLKLPLSYEVVPSLEYTTYQMLIDNLARAAEAYNNEFNRVDLFIRQNQILGSYLVEENKALAEKEKDMEELHNTLVKRKQDELEATIKKVDLLQIQMAEQKRAMDKAKEDMDSGLKEYEEKEIAKAFFAVLSAIGGCVLAFATGGAAGGGAAEGVEKAAEAVKEAEKAVSLLVKLVDTFKKLMDVLKKVQKVVEAVLAIKDLIEKIVDITKMVNAPPMPDLPSNADWEIFVNEVESVAENMPKEVSEVATWKCKCKNLAAVCREITTTVVYMQQLEYDLLVESLQAKVAAKHAERLQEIKPADVKNYLEMASQMNMRTTRILLNLLKVFKLQRGALLYHYLLPPNPFTGRVTIDTVRNALVQNAADAIMAMQQLGPSNNFEREYVVCDIPVDLLMQGQDWTFTIPIDDYVNTFPSAWCRVRIQHVEIKFSSGHHQPSTNDGEVYFLLQASRTFQDRGHSGDLLNYEAGVPLYYQYAYSLKSGKTTLSNKPTQEDEGLYMRLTPFTQWRLRLSASAYENQGLSFLTAKATDPSENTQISITFHLTAIRTVSF

SEQ ID NO: 283 - protein, 902 aa, Lygodium flexuosum
MSTAEAELMTSTAYESISNGAAWSPTNHTDDVAADDDEEWQDDMISMSDYEKLAYGDHYADYEAIYSGVNQLARAVGIRNRVECGEVLAIHQMFVRLDTLSVGNLLRPERVQRLIVFADVVEIKGATLTLPGSALVLIACRLLRVENRDVELNLSWNLAASSTGTPAPRCSIRAQEVITTSSTMPVLGCTLLIQVMHALTWNNNSTFTQYFGHRFSYSSENSSSTAPPVNQFMSSPGVPPTSNLILVNSKTVNILINNMRWKGYIDFQIGLPPWDDLVEPRLIDGIESTLLIAEMILSFQTNARDTVRAAKEHVEWINKALLQVVDAPNSEARFRLKILLARVQMLLKLSMDGSPPGLVVPVLEYSRYERVIRELVRVAELYNSEFNQLNLFIQQNQILGDYVLQQSKVLAEREKDVQALESSIVARKQQELNSAIRRVELLEAQLQTLATEMDEARENMDKGLQAFRNRQIAMAFFTVLGAALQLGGSLRLSSIPEIVVGIGASISEAINVAQQVEDAVASNNLVDVATKLVDVEKVIEVVNAIKQLYENDAFLEDILDAPEIPVIPSSDWDIMENNIEEVAAGMPTEVSEVVTWKTKGKNVIAVCREICATAISISELHYELFVHGKQRDIAQRHIERLEQMQTANLGEYIEIATQVDMQTMRLLIILLGNLAIQNGALHYHYLLPPEPLISWPSIDSVRRHLIQQEEKALLAEEGMGVPVRLSRAYVVEDVPVKLLLDGGDWIFTIDPSETLGFPDTWYRVRIRYIEMKFTGENIPQNPNTGKVYLLLQASSMFQDRYEREVFHYEAATPHNYQFAYELDSGEVTLPNEPAEAGRHFLMTPFTRWRLRLSASAYQNQGVFFPGTHDDGASTNISITFHVTSIVGIQHRIAEEEETLVIN

SEQ ID NO: 284 - protein, 708 aa, Lygodium flexuosum
MAAKPVLEINVADDMDYAELYRDVNQVTRPVATRQCSEVMAVHRMYFRLDDLHVDNLQNSQVVKQLYVFADVVEVEGDSVELPGSGQVSIFCRVLKLKRSEAAIRLSMLEAVRCTGRQRRTALGQDVEYYWVTPQNRLDGAGPVVTVLAAQLVAPPGAAQLRLTYPLIVDARVYDSDGYHPDFFTSNGTMEWRISTPTNGSSNTNPERTCGARTVIRPGIQWRAFEEEWYPSFRVLVAEAIPPEMLDNSNVLLGMESTTLISELVMAYQREAKDTMAATLRHVEWLNHQLLAVNQDTHSNFQFHHKQQIQSLHFRVQSLLKLPNATDDAKTLIVPPLQYNVYSNLISLMTQAAQSYDNDFKNLNLFMQQNEILGSFLLEQNKAFAAKERDMESHHSQLVNLQEEQLVTAKTRVDRLHDQLERESQAMDEARADMEAGIREYRNRLVAQAFFAVIQAVAAVCLAAFTGGATAAGAVGSAKQLSEAAQALQSVVELLERIEQIVEMVNAVTDFLSALESLNQMIELPEMPELPSTADWDIFENEIVAVAEGMPTEISEVPVWKAKSLNVAALGREIITTVAYIQQLQYDLGVNGMLQRIAQQQAERLESLQIQDLDNYLEMATELDMRTSRMLMSLLKVLTLQTAALSYHYLLPPRPLIGWVRMDSVWNALVRNAYDAVIALSSLGPSTDFVRTYDVKEIVTFEWTRLDL

SEQ ID NO: 285 - protein, 896 aa, Lygodium flexuosum
MAGSAGAADAWREVYRDLNQVSDRIRLDQLEFSEVMVIHRMHIKMSELDLGHLEGAEKVERLYVFADVVELDVVPHESSSDGDVVVRLPGSKFVTFVCRVWHINYALVQISSFARITRSVVLELRHMRWHFNAITGRMHLLDPQTLQDGMDLCFCVHAEVVQIAYYPDVTFPESNDSPSFLRFLRLEIVPDQLRVTTQTDGPVWALRGSLDYFMTPDNDGLLNEVSSQPAGTSFVLNILPDNLDVQLYANLRPNSGTTLTRDPNSIVPAFSVYKEKAGELLSDPNILPAMQTSMLIGELVEVGQPPSVTTEVVRKHVEWLNNLLLQVIEAKRGEHVEDYVELSFRAQYVIKKVGRIQRLVVPQLQYSAYSNLINRLAQVAESYDQALRQFRLFIQQNKILGGFLLEQNRAFAEKEQDMDIFYSELIAQRQIELDSILQKMKHLGAQMETQTADMEQAQADMEAGGSVGIREFQNRQVARGLFAVLGAIAAIGLTLLTGGAAAPLAVSAARSAVSLAGAVAQGLQRVLDILEGLQVVMEVVELINGLISSLQELGQPVELPEMAEMPTEADWLIFVNEVEGVAEQMPTEVSEVVAWKTKCKNVAVLGREMTTLAAYISQLQYDINMQHMLQRIARKQADRLSAIELPDLRNYGELVTQMDMRTTRLLVALIKVVNIQNAALMYQYLSEPTPVYAWPVNMDSVWRMLVQHEQFAIQGLMRLGPAFDIVRTYEVKGIPVSLLLDGDDYEFEIPAQDHVTFPLSLSRVRIHHLEMKFVQGEGDQLHMPVTDTGSVYILLQGSRNFHDRSEGSILHYEAATSLDYHFAYRLDTGETTVTNLPSAEFLTTFMRMTPFTNWRLRVSASAEENKGLAFPTATSADATTHIAITFFISAIRQIAL

SEQ ID NO: 286 - protein, 817 aa, Marsilea mutica
MDYTKLYNDVNQVSIRLELMDFSETMVVHRMLVRLDELDVSSGTGLISGAEKVKNLYIFADVLELPSASKKVRLPGSDKIIIVCRTFVANAQSSSTDLPLTSGVKFNMETGSKSTSVGGAYASSTKSSSSTAKGLQLKIQNGSYKSTMRQGSLSASEASTLELDISTTSGIINVITLNTSPSGSICFVGMTANATPPSTVVDVITDANVLLGMEVSLQIAELVKTANNSEDLLTAVTAHVQWLNDLLLQAVDALGVDKAGEAATLLCRAQGFLKTKRPNLTVPRLQYSMYKNLIDRMVQAAQDYNQSFVQFKLYVAQQKALGSFLLEQNKAFAAKEKDMESFYTQVISLRTTELKNAISRMETLSDQMDEESEAMDKAREDMEAGLIEYQNKQLARAFFAVIGAIASIGLAFATGGATAPGAVSSAQTAVTAAGKAAEGLQKVVDILKGLEEVMALVAAIKELVESISNIGELVNAPEMPDMPTDADWDIFVNEVELVAEQMPTEVSEVPAWKAKSKNVAALGREMTTTATYISQLQFQITVDQMQLEVAQKQYDRLSSITIGDLTSYLEMVSQMDMRTTRILVQLINVLYIQNAALYYEYLLVPEQLSAWPVTMQTIWTLLIQQEVKAITGLTELGPSSDFTRSFIVQDIPLSLLKSGNDWEFEFPVSGADVFPIAWSRVRIDYIEVKFPSTARHAPSTSTGEVYILLQGSRFLDDRAKKDNEYISYEATTGVPYQYAYRLSNGETTVSNIPSQEYRNTFMRMTPFTSWRLRLSISAPENQGLDFPTSTSIGDKTQVEITFYVTAIRRISTRDQPI

SEQ ID NO: 287 - protein, 767 aa, Marsilea mutica
EGEESVHLCRCGGVTISVKESVRLPGSDKIIIVCRTFVANAQSSTTDLPLTSGINFKMETGFKFTGVGGMYITSTKSSSSTTKGLQVRIQNGSYTSTMRQGSLSASEASTLALDISSTSGIINVITLDTSLIGSICFVGMTNSAIAPSTAVDVITDANILLGMKVSLQIAELVKTAHNSEDLLAAVTTHIRWMNSLLVHAVEELGVANAGEAVALLCRTQGFLKTKRPNLIVPRLQYNMYKNLIDRMVQAAQDYNRSFLQFRLHVQQQKALGSFLLEQNKAFAAKEKDMESFYTQVISLRSTELGNAINRMENLSEQMADESAAMDKAREDMEAGLIQYQNRQVARAFFAVIGAIVSTCMAFATGGATAPGALASAQNAVTAAGDAAGGLQRVVDILQQLEEVMALVAAIKDLVDSIRNVGELVNAPEMPEMPSDADWDIFVNEVELVAEQMPTEVSEVPAWKAKSKNVAALGREMTTTATYISQLQFQITVDQMQLEVAQKQYDRLSSITIGDLTSYLEMVSQMDMRTTRILVQLINVLYIQNAALYYEYLLVPEQLSAWPVTMQTIWTLLIQQEVKAITGLTELGPSSDFTRSFIVQDIPLSLLKSGNDWEFEFPVSGADVFPIAWSRVRIDYIEVKFPSTARHAPSTSTGEVYILLQGSRFLDDRAKKDNEYISYEATTGVPYQYAYRLSNGETTVSNIPSQEYRNTFMRMTPFTSWRLRLSSSAPENEGLNFPTSTSTSDTTEVEITFYVTAIRRISTRDASI

SEQ ID NO: 288 - protein, 409 aa, Marsilea mutica
SKRGHGSRPDRVSKQAIGKSILCRDRRHSLYWSSIRHWWCNSTWRMALVAAIKELVESISNIGELVNAPEMPEMPTDADWDIFVNEVELVAEQMPTEVSEVPAWKAKSKNVAALGREMTTTATYISQLQFQITVDQMQLEVAQKQYDRLSSITIGDLTSYLEMVSQMDMRTTRILVQLINVLYIQNAALYYEYLLVPEQLSAWPVTMQTIWTLLIQQEVKAITGLTELGPSSDFTRSFIVQDIPLSLLKSGNDWEFEFPVSGADVFPIAWSRVRIDYIEVKFPSTARHAPSTSTGEVYILLQGSRFLDDRAKKDNEYISYEATTGVPYQYAYRLSNGETTVSNIPSQEYRNTFMRMTPFTSWRLRLSSSAPENEGLNFPTSTSTSDTTEVEITFYVTAIRRISTRDASI

SEQ ID NO: 289 - protein, 522 aa, Huperzia carinata
ILVFPFCVCMCARGSLLLHSGKILGSYLLQQNKAFAAREKDMEAFHGLVVARKQEELRAAQEMMNSLNAQLTHQTEAMDQAKKDMDEGLKRYRDEQVARAFFAVLKGVLEIGAAIFTGGATAGLAVKGAINAVNAVSNLAGMLDMVIKIMEGMEQVMEVLNAIDDLVTALSEINQMVEAPQMPSMPSTAEWDIFENEIEEVAESMPTEVTEARTWRTKCKNVAALCRAICTTGSYIGQVQYDLFVHSNQELIARRQAERLEAIQPANLTNYLEMATQMDMRTSRMLLGLLKVLTLQNGALKFHFLLPPKPFTGWVTMDMVRNALVQHEADALAARERLGPSTDFTWTYVVSDIPISLLLDGDDWIFTIDPADGSAFPLSWSRVRIRYLEMKFTGGEEFHKPTTNSGEVYILLQASRIFQDRLLGEVLHYEAAVPLRYQYAYALESGETTVSNRPSQQHDGEYMQMTPFCQWRLRLSASALENQGLAFPTAAADLNSSTTQVSITFWLTAIRRIDTRLLEVSQ

SEQ ID NO: 290 - protein, 824 aa, Polypodium musifolium
MFVRMDDLDVSSGCRSAMADLDYSKLYQDLNQISVRLEKTEFSEVMVVHRMFVRMDDLDVSSGSGLLSGAEKVKRLYVFADVVELPSKQVRLAGTDMIVVFCRIFVPEGRHYAELFLPSMNMSMVGADGEGSIRGVILSPTVLTTLSNALQFRLECGSMTSVMRLNDVSAGATLTCNVQGASACVPLKVKTTGTSPGNICVLGLSTAAVVPESVVAVITDANILLGMQVTVLIAELVKIAHNSDGVIAAVTRHVEWLNHLLVQAQAAAPSEDVVALLYRTQAFIKLRKEGLIVPRLQYHMYKDLIDRMVQVAQSYDQDFKQMKLYVEQNKILGSYLLEQNKAFAEKEKDMDASHSQVIALRTSELQSTIERMDDLSKQMEVQSKAMEKAKADMDAGLIVYQNKQVADAVFAVMEAIASIGLAFATGGATAPGAVASAGAAVSAAGKAGEGLKKVVEILEGLQAIMEVIAAIKGLVQSLQKIGQLVNAPEMPDLPSEAEWEMFVKEVEAVAAQMPTEVTQVPAWTAKCKNVAALGREMSTTAAHIAELQYEIQVQGMLQQIAKKQADRLSSIKPADLTNYFEMVSEMDMRTTRMLLELIQVLNIQNGALRYEYLQPAAPLNAWPVTMQTVWGLLVQQEAAAINGLLQLGAPSDFTREYVVGDIPVKLLLGGGDWEFELPVTDADFPLTWCRVRIQHVDMQFDAVAEHLPTTSTGEVYMLLQSSRFFEDRAQHEDEFISYEAGTGLQYQYAYRLATGEATVTNVPSEAYVNTFMLLAPFTRWRLRLSSSAPENKGLAFPTATSADATTRIKITFHVSAIRRISLAR

SEQ ID NO: 291 - protein, 902 aa, Polypodium punctatum; identical to SEQ ID NO: 82

SEQ ID NO: 292 - protein, 907 aa, Polypodium punctatum; identical to SEQ ID NO: 81

SEQ ID NO: 293 - protein, 922 aa, Polypodium punctatum
MHPTGHDGISNIPLEQCHDDYAEERQMKPRFETNGLELDYEKIYAGSNSIAREVGLDKVNCGEVMAIHQMFFRLDTLSQELLRRPELVKRLIVVADVVEIEGSNATLSLPGSSLVLIFCRILILKSRNLVLDLDNWNLRAASTTPLHRCSIRAQRVVIASGFSLYSSLLIQVKHKFEWSDGTHLDQYFGRPFYFTAIGINSSATITTTATSAMRSINTWPGTAPVSNFIRVNSEKFNVLVNAVPWKGVIDCQAALPSLDDLLHPDVISGFQSTLLIVETILNFQTDNPAIISLARQHAEWILDSLLQVVPLPDSTLGVPEAKTLLARAQILMKLPTDGSQHLRVPLLAYGEYQEDIERLLRNAEAYDQEYRELTRFVQLVEIIGSEFLQLSRSLAQRERDIEAFESLAVIRKQSELDQAIRRMNSLMPEIERRSFEMADAKARMEEGCLFYRMFTSYITVKCKTSKLTCLIAAGLEDYNRRQLTRAIFGILGALLQLCASLKFGGGADIAGGIATTVPAAIDLIHAVQDTSASTKLLAISQTLMDLEKIVDVVNAVNTLAESATELEDIVHAPELPLIPPYTWDILENDIEEFAALMPLEVSEVVTWKAKCRNLVAVCREICIAASFACEVQYELFVHARQQEMARRQAERLEGMQTAALSSYIELATQADMRTARLLLSLLNVLAGHQGALHYHYLMELEVFTSSWPTVDSVRTHLLQLNQRARARENALFGDGVLTVDLQHDYVLDAIPVSLLLSGEDWNFTINPERNASSFPTPWDYVRIRYVEMRFTGEHLPVSETGEIYLLLRSSANFQDRLEEQVLEYEAAVPLVYQYAYNLSTGATTLPNQPSESGKFFRMTPFTRWRLRLSASAYQNQGVSFPTLPGDPNSDSPVQITITFFVTALPQIQSRSLDMSDGDPTEE

SEQ ID NO: 294 - protein, 888 aa, Nephrolepis exaltata
MEYSDLYADVNQVSLRFQETEFSEVMVVHRMYLRLQDLDMKTQPFPSMLWGSEKVQRLYVVADVVELPSTPTTMLFPATVSVVILCRVLYVHDLSLHIGTCGIQFTLLRLRLVETKEGLVKIFPIPASASSKDTDIGLYIHTDRVIYRQNTSSDDVHILQPLQMRVWGIWADSTFSTEVRANWPTTLAVHVLILWLTASKGQRIPATESDLQRSDEFELLCPPTPDKLKVSFASPVPPGIPSPIEVDFENTFSFFRVPPADAIPTEVLTNPYIILGLQMNMLIAELVLAAHNSPRVINVVTKHVQWLNKILKPKLGLANDDILALVFRVQSFLKTANQPRSIVPRLQYHMYSKLIDHMVQVAQAYDQEFKQLKLFIVQNQILGSYLLEQNKAFASREKDMSAFHSQVVSLRRTELSTAIGRMDQLSVQMERENKEMDQARVDMMQAIKDYQKKQVANALFAVLGAIASVALAFATGGATAPGAVAAAGAAVTAAGKLAEGLQKVVEILQALEVVMEIVGAIRDLVESLQNLGKLIDAPEMPDMPSDADWRIFVNEVEAVAEQMPAEVVGSVAVWKAKCKNVAVLGQEMCTTAAHIGELTYQIKVEEMLQEIAQRQADRLEEITPADLSSYTEMLSQIDMRTTRLLLQLIRVLYIQNAAIKYEYLYDASSQLNSWPVSMDTVWSMLLQQENSALMGLLDLGPSTDFTRSVVVKDIPVGLLVDGNDWQFVISVEDSAAFPIGYSRVRIRYVELKFEQGSNEDGTVIHQPHTDSGLIYMLLQSSRFFRDRKRREILDYEASMGLAYAFAYNLTTGVPTVTNIPSQQYAHTFTSMTPFNNWRLRLSASAEENQGLTFPTATNSPDARTQIALTFHITAIRDIDTLAAADDDE

SEQ ID NO: 295 - protein, 900 aa, Nephrolepis exaltata
MATVVKAGRGTVTRDYEELFRDLNQISDRIRLDQMELSEVMVVHRMFIRLQELDLGHVEGAEKVKHLYVFADVVEVEEGGNSAVWAPLARLPGSITVVILCRVVSVAGILLMGSSTFNNAMRIQLPHMKLRAVEITTQSPAKLQMHRRDAALADEQYPALCIHASVIQCSNIRSAVPVNLQRFPVSLQFFSYMPDRESNEVVLSSASRQLVDEPVDSFNVHTLAPEYIKGVPIPEVATIDSASLSENSYSVQISRLNLSLSNSIAAEGELEPAFSLLKPKVPFTVLIDPNILLAMQTSVLIVELVELAHPSADTRDAVTKHKEWINQLLLQATSANGEGTNASLDEHRALLFRVQYLMKRIPGREDSLVIPRLQYDVYSSLINRMAQVAESYDQSLRQLKLFISQNRILGSYLLQQNQAFAEKERDMDVFHSELLSQRKLELEDTIHRMGLLGSQMETQQREMEQARADMEAGLREFRERQLARAMFSVLGAVAAVGLAFLTGGATAPAAVRAAHTAVSVTSSIRRMFETVMQVLDGIQAVMEWVVLIKELVSNIQDLNKLVEAPEMSEPVPTQADWDIFVNEIEAVAEQMPTEVSEVSTWKAKCKNVAALGREMTTMAVYISELQYEIKVQSMLQEIARSQADRLSNIQAANLRSYTEMVTQMDMRTTRMLVSLLEVLRIQNAALMYQFLSPPTLMDAWPVTMETVWRILVQHEHTAILGLMRLGPSFDFMRTYVVEGIPVDLLLDGEDWEFEIPVEDYITFPPTWSRVRIHHLEITFVQGADVHQPMTETGKVYILLQGSRIFHDRNQDDAILYEAATPLDYHYAYRLDTRETTLSNLPSHDFTRTFMRMTPFTNWRLRLSASAEENKGLRFPTATSADSTTQIAISFHVSAIRRVSL

SEQ ID NO: 296 - protein, 888 aa, Nephrolepis falcata
MEYSDLYADVNQVSLRFQQTEFSEVMVVHRMYVRLLDLDMTTEPHLQMLAGSEKVRRLYVVADVVELPATATNMRLPATASVVILCRVLYVQDVNSPYLACGLHFPLMPLRVVEDTQQGRVRVFPVVGGGSASVDMNNQIGLYIHADRVVYRQGTSTADPLQPLQLRVIGNGSTFSTEVRPDWPKTLEVSSLLMWLTLSKGQPIPAAESDLQRHDEVELLSPPSPDRLSVVFAYLAPGNLFSIAVDVEYIGAGFCYFRIPPADPVPTEVLTDPYVIIGLQMNMLIAELVLAAHNSPPVISVVTKHVEWLNKILQPKLSLPNDDILALLFRVQAFLKMAKQPRSVVPRLQYHMYSPLINRMVQVAQVYDQEFKQLKLFIVQNQILGSYLLEQNKAFASRETEMSSFHSQVVSLRRTELNNAIDRIDQLSVQMENENEAMDQAKEDMMQAIAEYEKKQLANALFAVLGAIASVALAFATAGATAPGAVAAAGAAVSAAGRLAEGLKKVVEILEGLAAVMEIVAAIRDLVESLQNLGQLVETPEMPDMPSNADWLIFVNEVEAVAEQMPAEVVGSVAVWKAKCRNVAVLGQEMCTTAAHIGELTYQIKVEEMLQEIAQRQANRLESLTPANLSSYTEMLSEIDMRTTRLLLQLIRLLHIQNAAIKYEYLYAAGEQLNSWPVSMDTVWSMLLQQENSALVGLLDLGPSNDFTRSFVIQGIPIGLLVDGNDWQFSIPVEDSPTFPIGYSRVRIRYVELRFDQGTSDEGRMIHQPSTSSGLTYMLLQSSPVFRDRRRREVLEYEASMGLAYAFAYNLTTGVPTLTNVPSPEFANTFMRMTPFNSNWRLRLSSSAMENQGLMFPTASSADDTTQITITFFISAIRGIDTRAAVEI

SEQ ID NO: 297 - protein, 872 aa, Nephrolepis falcata; identical to SEQ ID NO: 90

SEQ ID NO: 298 - protein, 856 aa, Nephrolepis falcata
MASLTPDYYTIYKNVNQVSRPVASRQGSEVMSIHRMYFKLDMLKVELLTEADAVKELVVFADVVEIEGQKMDLPASRFVTIVCRILLVKEEDVELSFKFLEPAPYFQALDPGSQSALVWASSTQVRLSIHAQQVLCNSTRATMRVTHPVVIGNRIDLEYRCLEGQTHCEIIASVGTVSGTMNWQIEISSDHADLSAAQRSHELRSWEGQRETVWSVVEQNEWPAFTSLLDPVLIPLARLGDSNIILGMQSTLLIAELVLSYQTHAQDTVSAAHRHLQWLITNLLQVLKGNSLKEETREQLLALLARAESASKLPLDGTHTLIVPRLQYSQYRGLISSMAAVAQAYNSEFTAVNLFIQQNEILGGYLLQQNKAFAEREKDMTAFHGLVVERRKDELRAAQETMEDLNTQLAQQTEAMDQAKQDMDAGLKRYKNEQVARAFFSVLKAVLEIGAAIFTGGATAGQAVKGAVDAVNAVSSLAGKLDMVLSLMERMEKVMEVLNAINDLVTTLSEINKMVEAPEMPSMPSMYEWDIFENEMEEVAESMPEEVTEARTWKTKCRNVAAVCRAICSTASYIGQLQYDLFAHSNQELIARRQVERLEAIQPADLTDFLEMATQLDMRTSRMLLNLLKVLTVQNGALLFHFLLEPVPFTGWVNMDMVWNALVKHEADALVARERLGPSTDFVQTYVMSDIPISLLLDGDDWIFTIDPADGSTFPLSWSRVRIQYLEMKFTGGEEYHKPASNSGAVYILLQASRNFQDRLHERVLHYEAAVPLRYQYAYNLQSGETTVSNRPSQQHDGEYMQMTPFCQWRLRLSASALENQGLAFPTVAATDLASSTTQISITFYLTAVRSINMRQ

SEQ ID NO: 299 - protein, 838 aa, Osmunda regalis
MASVDYGEIYKNVNQITRPVATKECSEVMAIHRMYFQLDNLDVELLTKANTVKQLVVFVDVVEIESDNVKLPGSSQVTIVCRILHVKKNNVALNFDFLGPTKCNGRSTRGYARIMDDSPVFELSIYAQQLVGDDGAMLRVRHPVTVATIENGHDYEVREGNMEWQIWPYSSTGLSSAARSHELKTIGDHGRERTWLIIEQEWSRFIAVVPDLIPLRWLTDSNVLLGMEATLLTAELILSYQTDAQATVAAALQHVEWLNTQLLQVVEETDLEATGERLLSLLFRAQSLLKLPVDGSHTLIVPRLEYGLYRDLINRMTDVAEKYNSEFMQMNLFIQQNEILGTYLLEQNKVFAQKEKDMEVFHSSLVTLKQQELTAAMNKMDRLKTQLTEQKTAMDQAKKEMDEGLQKYKNEQVAKAFFAVIVGVLEIGLAIFTGGATAGAAVAGAAEAVEAVSEVAKTLGKVVDILKGLEKVMEVLNAIKDLTASLAEINQMVEAPQMPDMPSEADWAIFENEIEAVAESMPTEVSEVPTWKAKCKNVAAVCREITTTATYIGQLQYDLLVQSMQQQIAMRQAERLEAIQPADLTNYLELATQLDMRTCRMIVGLLKVLTLQNGALQYHFLLPPKPFTGWVSMDIVRNKLVQHDYEAVIARSQLGPSTDFTRTVVVEGIPVTLLLEGDDWNFTIPVHDSAFPSNWSRVRIRYLEMRFSSSEEVHQPTTNTGEVYILLQAARMFDDRLKGDVLHYQAAVPLQYQYAYDLNTGETTQSNLPSEEHTGEYMRMTPFTRWRLRLSASAYENQGLAFPTATALDSTTQISITFFLTAVRQIDTRLTELMDEPQ

SEQ ID NO: 300 - protein, 878 aa, Pellaea rotundifolia
MEYGSLYGDVNQVSLRFEKTEVSEVMVVHRMHVRLEELDMSSDKLKRLYVLADVVELPSQRQTIVIPATVSAIIMCRVLYIPYIWTVVDNCTLVLPHMRFRVVETSNIAPRTGQFFALPPSDAAVDNDVGSFGGLYIHADRFIYRQATSFTSDWVQPLGLRVRGSSTFSSTFRPDWPETLPVNNLNQTITLSLGSFLTPSDSDLQRSDEIEFLQTEPQRVQVVVDRGPGSQTGLVLLVENSPEISVFPAPSLEHVPADVLADPSIILGMQMNMLSAELVLAAHNSQQVIKAVSKHVEWLNKILLQVASPSDDILALLFRVQAFIKMAKQSRFVVPRLQYHAYSNLINRMVQVAQVYDQELRQLRLFIAQNEILGSYLLQQNKAFAEKEKDMSAFHSQVVSMRRSELSSTIEMMGRLSSQMETESEAMDEASDSMVAAIQEYERKQLARALFAVLGAIASVALAFATGGATAPGAVASAGAAVTAAGRLAEGLRRVVEILEGLQAVMEVVAAIRDLVESLENMGQLVEAPEMPEMPTNADWLIFVNEVEAVAEQVPEEVSEVPVWKAKCKNVAVLGQEMCTTAAHISELQYQIRVEEMLQEIAQRQADRLMGISAADLSSYTEMATQIDMRTTRMLLQLIKMLYIQNAAIKYEYLYPASERLNSWPVTMPTVWTMLLQQENAALLGLLDLGPSNDFTVTHVVKDIPVKLLVDGYDWHFEIPVEDSAIFPAGWSRVRIRYVELKFDKQGTDSNIVIHQPSTNTGEIYMLLQSSRFLSDRKREEVMDYEASTGLAYAYAYDLSTGATTLTNIPSEAHANTFMQMAPFTAWRLRLSASAMENQGLVFPTATSPDNTTQISITFYVTAIRRIDTRRQRADAEL

SEQ ID NO: 301 - protein, 564 aa, Pellaea rotundifolia
AATIYNSRGGEFKYSVHSSPMVEIVLHAGDLSQPALMAGWSVQAKPSPDAPAVLFLHSQQVLVITSNSPPISHTSVNVVLQAEGAAQYTLYSDHHQKEGDISEGLPTEIKLERSDLNSTLLAALEATVLTTELILSYMTDATETVTQATLYLEWLNNQLLYAQNGTTDASVSLDETVDRQFHNLMFQVQCLLNKPLVATGLLVPRLQYCTYSNLVNTMARIAENYNKEFRQLTLFIQQNEILGTYLLQQNKALAEREKEMEVFHSELQQVKKDDLMRSLVKLERLEVDMKNMSAEMEQAERDMEAGIIRYRNRQVARAVFSVLGGAIAQLASAFFTGGATAGPAVAGAANAVNQVTEVVTSLQRVVETLEKLVLVTEFLVAMRDLMNAVNDIHGGVPEVPALPDMPSDAEWAIFENEIEAVAAGMPEDVSEALTWKAKCKNVAALGREMVTLATVIGQLQYEIKVHELLQEIARNHSERLEAIQPADLKNYQEIATELDMRTIRMLLGLLEVLSLQNAALHYQYLLPPSPVTTANTNISMSTVWALLLQHEAVAVIRLADLGFA

SEQ ID NO: 302 - protein, 895 aa, Pellaea rotundifolia
MAAGSVGVDYRELYKDLEQISERVRMEQMEFSEVMVIHRMFINLRDLDLGHLEGAERVKRLYVLADVVEAQQSHEGANSLLTPTARFPGSISVVILCRVLWLREVSYGARITAFNVMWLQLPHTRLHAVERSATSIRMYRHGEDEDDDAYPALCIHASIVEYSKIERGHAVPQPSPSTYILRCFALRPSPNSSTNLVFSSQSRSLVDAPVREYFVYPEARNVFPSTFPTSAIIDPASLFRDWYTFRLASVTLNLSAADVSKDQLEPAISLLKDNIPAAILTDANILLTLQISVLIAELVQLAHPSKDTVEAIAKHVEWLNKLLLQATSNSTGMSSHDDYLALLFRVQCLMKTRRRARSLVVPQLQYNVYSNLINRMAQVAQSYDQALQNLKLFIVQNRILGSYLLEQNKAFAERERDMEVFHSEIIAQRMLELKNTILKMDHLSVQMETQREEMDRAREDMEAGLREFQNREVARAMFAVIGAIAMIGLAFVTGGAAAPGAVAAAGNAVTAAGQAARALQRVVEILEGLQAVMEVVVLIKDLVESLQNINQLVDAPEMPEMPSQADWSIFINEIEGVAEEMPVEVSEVSAWKTRCKNVAVLGQEMTTTAAYISQLQYDIKVNSMLQDISRGHADRLSTLRPADLSNYLEMVTQMDMRNTRMLVSLIKVVDMQNAALMYQYLSSPTPLNAWPVTMETVWSMLVQHEHGAVLGLMSLGPAFDFTRTYVVKDIPVSLLLQGEDWEFEIPVQDFVTFPSTWSRVRIHHLEMKFVKDSAHQPTTATGSVYMLLQGSRIFHDRRNHVIRSTDTILHYEAAVSLDYHYAYRLDTGDTTLSNLPSHDFLTTFMRMTPFTNWRLRLSASAEENKELDFPTATSADATTQIAITFHISAIRQTSL

SEQ ID NO: 303 - protein, 544 aa, Pellaea rotundifolia
MVEIVLHAGDLSQPALMAGWSVQAKPSPDAPAVLFLHSQQVLVITSNSPPISHTSVNVVLQAEGAAQYTLYSDHHQKEGDISEGLPTEIKLERSDLNSTLLAALEATVLTTELILSYMTDATETVTQATLYLEWLNNQLLYAQNGTTDASVSLDETVDRQFHNLMFQVQCLLNKPLVATGLLVPRLQYCTYSNLVNTMARIAENYNKEFRQLTLFIQQNEILGTYLLQQNKALAEREKEMEVFHSELQQVKKDDLMRSLVKLERLEVDMKNMSAEMEQAERDMEAGIIRYRNRQVARAVFSVLGGAIAQLASAFFTGGATAGPAVAGAANAVNQVTEVVTSLQRVVETLEKLVLVTEFLVAMRDLMNAVNDIHGGVPEVPALPDMPSDAEWAIFENEIEAVAAGMPEDVSEALTWKAKCKNVAALGREMVTLATVIGQLQYEIKVHELLQEIARNHSERLEAIQPADLKNYQEIATELDMRTIRMLLGLLEVLSLQNAALHYQYLLPPSPVTTANTNISMSTVWALLLQHEAVAVIRLADLGFA

SEQ ID NO: 304 - protein, 866 aa, Pteris cretica
MADVDYSVLYKDLNQISIRLEKMDFSEVMAVHRMFVRMDDLDVSSGTSGGLLVGAEKVKRLYVFADVVELPSKQVRLPGSDMIVILCRIFVQNGRHSTELFLPSMNVSMGAAGNGSIRGANLSTTIMSSSSNVLQFKLQSGTMTSAVRLKDVDAAAALTCDVQAVSASMPLTVMATGTSPGNIWVLGMTTAVVVPKSAVAVITEANILLGMQVTVLIAELVKTAYNSDAVIAAVTRHVEWLNHLLVQAHAAAPKLGMQVTVLIAELVKTAYNSDAVIAAVTRHVEWLNHLLVQAHAAAPNEDVVTLLYRTQAFLKLQREGLVVPRLQYHMYKNLIDRMVQVAQSYDQDFKQLKLYVEQNKILGSYLLEQNKAFAAKEKDMDAFHTQIITLRTTELNNTIERMDQLSKQMDEENEAMEQAKADMDAGLIEYQNKQVANALFAVLGAIASIGLAFATGGATAPGAVSAAGAAVTAAGKAAEGLKKVVEILEGLQVVMEVVAAIKELVQSLQQIGKLVDAPEMPDLPSNADWEIFVNEVEAVAEQMPTEVKQVPTWKAKCKNVAALGREMSTMAAHIAELQYQIQVQEMLREIAQKQADRLSSIKPADLTNYLEMVSEMDMRTTRMLLELIRVLYIQNAALQYEYLQTPAPLDAWPVAMSTVWNVLIQQEMSAITGLLELGAPSDFTQEYVVKDIPVSLLQGGQDWEFELPVSGADFPSSWLRVRIHHVAMQFDGSAAHVPTTNSGEVYMLLQSSRFFDDRARRATEFISYEAGMGLYYQYAYRLATGEATVTNIPSVEYANTFMRLTPFTRWRLRLSASAHENNGLAFPTATSADATTQIKITFSVSAIRRIISTYNPHISLPSDVDR

SEQ ID NO: 305 - protein, 873 aa, Pteris cretica
MDDEMEQEGLKVFAAQSDKDYEALYASVNQIARVVGMSKVRCGEVLAVYRMFVRLDSLDVAHLLQPERVRRLIVFADIVEIDKNSVALPGSALVLINCRLLHLKNRDVQLDLPYWIVENNHNAVALPRCSVRAQQVVVSPNAPTPPPLSSNGSLIIRVKLDLKWADNSPFTQYIVRYFSYNSHEAYTDIKAPVSTSKPPSFHWLLIPPLSDRRIKTAAINDIKWQADIAFQEALPSLDDLRNPHVIKGMESTVLIAETILIYRSDLMDAVTEALQHVQWINKSILEAVRLPNSESGLQLKRLAAHVQMLLKFPVDGSHSLKVPRLQYGKYDDLINRMSVVAEAYDSEFKTLKLFILGNQIIGDYMLTQMKLLAAKEKDVAGLESLIVLRKERELKEALETIDSLEKQLLKQFNEMTEAKTQMEQGLKEYENKKSAQALFAVLGASMQIAGSLMSGNISGVIGGVGGSISAMKDAIDAMDDLAASRSLLNVASGLVEVNRVFEVVNAVSELYETATSLEDLLEAEKMPNIPSSDWDMMENEVEAVAATMPTEVSEALVWKAKCKNVIAVCRELCSTAVSMSELQYDLFVHASMQEIAQRQAERLEEFRASDLGEVTEMATQVDMQTMRVLLSLLSTLAIQNGALQYNYLMVSEPFTGWPTVENVRSSLVRRQQQAIIESSHMGPSTIMPPHAYVLESVPVGLLLSGEDYMFTIDPSCSDFEDSWSRVRILHLEIKFTGGHLPRAGPRNEAYFLLQASSQFQDRWGAQVFHYEAAAPLMYQYAYNLNTGATTLPNMPFEEDTFLRMTPFTHWRLRLSASSPRNEGITFPTALAPDSTTQITVAFTVTAHPRPYVSFSLDGKIDVEQIPEKQPEDQ

SEQ ID NO: 306 - protein, 889 aa, Phegopteris hexagonoptera
RDSVDFGEYRDLNQVSERIRLDQMEFSEVMVIHRMHIKLSELDLGHLDGSEKVKLVYIFADVVESDEEQTGALPVRLPGSISVFIMCRVWHVSAYVGNNGRNHRRVLRLPHMTLHFRNSSSALRSLYRIDPATREDVSEPALSIYADVVQAVLQNPANIPTTSISTDELYFEASGSEILYTRQVLHERVGLFVVRFSQWGIPVTPSVLAHNYSVTSLTNASLASGGGPLPTSIYSPAFSRGMLTSDIPVTFLTDSHILPAFQTSVLIAELVELGRPSQATIDAVGKHLRWLSKLLLKVIEETKGTAFRQDEYLELSFRAQCLIKKMGNIRSLVVPQLQYSVYSGLINRMAQVAESYDQSLTQFRLFIQQNRILGSFLLEQNRAFAQREKDMDAFHLELISERETELENTLEKLDQLNSQMQEESAEMERARERMESSIMEFQRRTILRAVFSIFSALAALSLSFLTAGAAAPAAVAGASAAVNAVSTAATIAVTLKRIMKMLEILETVMEVVAIIKEVISNMQLVDELANAPEMPAMPSDHEWLMFENDIEEVAEEMPPEVSGVSAWKARCKNVAVLGREMITTTTYISQLQYEIKVQRMLQQIAKRQAERLLAIQLPSLTNYTEMVTEMDMRTTRILVTLIKVVEVQNAALMYQYLSQPTPVNAWPVTMDTLWRMLVQHEHSAIRGLLRLGPSFDAGNCNYVVRRIPVYLLTHGEDWQFEIPLQLNDDDENEEDEYPAQVPFPTSWSRVRIHHLEMKFVRAPHVHYPTTKTGSIYILLQGSRIFEDRNQGARVHFEAATSLDYHYAYRLDTGETTLSNVPSIEFTQTFMRMTPFTTWRLRLSSSAIENEGLAFPTAMQSGPDSTEIHPDATTEIQITFNISAVRQISF

SEQ ID NO: 307 - protein, 896 aa, Phegopteris hexagonoptera
MIAAGAEDKLMSTCTYESVSPGSAESPAKRIDDDEAAAADEEYLQDDMSSMYAYEKLADDHDHYADYEAIYNGLNQIARAVGIRNTVECGEVLAIHQMFMRLDTLSVENLLRPERVKHLIVFADVVEIEGAALTLPGSTLVLIACRLLRVKNRDVVLNLSWNLASSSSPPRCSICAQHVITTSSTPLSGCTLLIQVMHALTWSNGSTFTQYFGRQFSYSSQNSSSTAPPPNQSLSSIGVPPSSNFILVNSKTLNILINNIRWKGYIDFQVGLPSFDDLVEPHFIDAIESTLLIAEMILTFQTNVRDAVTAAKEHVEWINMALLQVVDGPNSDARFRLKILLARVQMLLKLSLYGSTPGLVVPVLEYGVYDRVIKEMVRVAELYNNEFNQLNLFIQQNQILGNYLLQQSKVLAERERDVEALESSIVARKRQELNGSIRRVELLEQQLQALASEMDEARENMETGLQVFRDRQIAFAFFAVLGAALQLGGSLRLTSIPEIVVGIGTSISDAVNLAQQVENAVASNNLVDVASKLVEVEKVIEVVNAIKQLHDNETELDDILNAPEIPIIPSSDWDIMENNMEEVAAGMPTEVSEVVTWKTKSKNVIAVCREICRTAISVSELQYELFVHGKQQEIAQRQAERLQQIQTVELGEYIEIATQVDMQTMRLLIILLGNLAIQNGALHYHFLLAPEPLTGWPSIDSVRRHLILQEEKALLAEEGMGVPVRLTREYVVEDIPVSLLLSGNDWIFTIDPSSLSETPVFPNTWNRVRIRYIEMKFTGEHLPQSPNTGKVYLLLQASSMFQDQYAQQVFHYEAATPHSYQFAYELDTGVTTLPNLPAQEGRHFLMTPFTRWRLRLSASAYQNQGVFFPGPASASTNISITFHVTSVVGIQTFHDI

SEQ ID NO: 308 - protein, 592 aa, Polystichum lepidocaulon
AHPSADTRATTARHLEWLSGILLQALSKAEGTPSHKEYLALSFRAQYLMKTKGTTRRLVAPQLQYDVYSPLINRMAQIAESYDNSLRQFKLFIAQNQILGNYLLEQNRAFAAKERDMDVFHSELVSQRENELKSTLNRMGHLSTQMDIQVAEMNKAHEEMEAGLRRFQNRRVAEAMFGVLRAIGAIALSFFTGGATAGLAVRAARSAVSAAGALQRVMDTLEDMQAVMEVVFIIKELVESLQDIGTLVNAPDMPEMPSKEAWDIFENEIEGVAEEMPEEVSEVSAWKTSCKNVAVLGREMITTAVYISQLQYDIKEHTMLQEIAQRHADRLSTIKAADLSSYTEMVMQMEMRTARIMVALIKVIHMQNAALMYQCLWPPTQVTTWPSLTIETVWIMLMQHEHSALLGLMRLGPSFDFMRTYVVKDIPVSLLLNGEDWEFEIPVNDYITFPSTWSRIRIHHLEMKFAQGAHVHQPTTDTGKVYILLQGLRTFYDRNEGDTLDYEAAMPLDYHYAYRLDSTGETTLSNLPSNDFIKTFMHMTPFTNWRLRLSASAEENKGLAFPTAEEDRKTGSDATTEIAITFYISAIRRISF

SEQ ID NO: 309 - protein, 718 aa, Selaginella erythropus
SSIIGVAAAAAGSYHIMGNAGSINYEEIYKNANNIGRSMATPMCSEVMSVARMYLRISDLHPTRLKQPEIVKELYVFADVLRLDSFEIVLPGSDIVYILCRMLHWTIPAPALGSTVYIQTPWLKLSSATVIICPQLQQSPLEWFIKAEHSTRTDAPAPLFLHAKQVLTTSNTGSSHLNVVLQLAQEVAQTYMLSDQRDVIDVNVESGYTLSRRDLNSTLLSAMEATVLIAELILRYMTHATETVVEATLHVEWLNKLLVNALKDTSTASGSDDEAVDKQLHNLLFQLQFLLTRPLGAGVIVPRLQYSTYSNLVSTMGRIAENYDKEFKQFTLFIEQNEVLGTYLLQQNKAFAEKEREMEVFHSELQQVKKDDLTRAFAKLEQLEVDMREMSAAMEQAEKDMEAGLIRYRNAQVARAVFSVLSAIAQLASAFFTGGATTGQAVAGAANAVNQVTGAVSSLQRVVEPLEKLVLVTEFLVAMRDLVNAVNDIVQQVAPEVPALPDMPSEAEWAIFENEIEAAADEMPEEVSERLQWRAKCKNVAALGREMVTLATVIGQLQYDIKVHELLQEVAQNHAERLEAIQPVDLKNYQEMATELDMRTTRMILGLLEVLSLQNAALHYQFLLPPSPVTTASTTISMSNVWTLLLQHEAAAVISLRICDRPRGDVCCQGHTRWLAARWGGLGLSDLRQRCGRFPIWLEPCADLICRDEVCKSWYRIR

SEQ ID NO: 310 - protein, 702 aa, Selaginella erythropus
MGNAGSINYEEIYKNANNIGRSMATPMCSEVMSVARMYLRISDLHPTRLKQPEIVKELYVFADVLRLDSFEIVLPGSDIVYILCRMLHWTIPAPALGSTVYIQTPWLKLSSATVIICPQLQQSPLEWFIKAEHSTRTDAPAPLFLHAKQVLTTSNTGSSHLNVVLQLAQEVAQTYMLSDQRDVIDVNVESGYTLSRRDLNSTLLSAMEATVLIAELILRYMTHATETVVEATLHVEWLNKLLVNALKDTSTASGSDDEAVDKQLHNLLFQLQFLLTRPLGAGVIVPRLQYSTYSNLVSTMGRIAENYDKEFKQFTLFIEQNEVLGTYLLQQNKAFAEKEREMEVFHSELQQVKKDDLTRAFAKLEQLEVDMREMSAAMEQAEKDMEAGLIRYRNAQVARAVFSVLSAIAQLASAFFTGGATTGQAVAGAANAVNQVTGAVSSLQRVVEPLEKLVLVTEFLVAMRDLVNAVNDIVQQVAPEVPALPDMPSEAEWAIFENEIEAAADEMPEEVSERLQWRAKCKNVAALGREMVTLATVIGQLQYDIKVHELLQEVAQNHAERLEAIQPVDLKNYQEMATELDMRTTRMILGLLEVLSLQNAALHYQFLLPPSPVTTASTTISMSNVWTLLLQHEAAAVISLRICDRPRGDVCCQGHTRWLAARWGGLGLSDLRQRCGRFPIWLEPCADLICRDEVCKSWYRIR

SEQ ID NO: 311 - protein, 575 aa, Polystichum polyblepharum
CGSDQRDVIDVNVESGYTLSRRDLNSTLLSAMEATVLIAELILRYMTHATETVVEATLHVEWLNKLLVNALKDTSTASGSDDEAVDKQLHNLLFQLQFLLTRPLGAGVIVPRLQYSTYSNLVSTMGRIAENYDKEFKQFTLFIEQNEVLGTYLLQQNKAFAEKEREMEVFHSELQQVKKDDLTRAFAKLEQLEVDMREMSAAMEQAEKDMEAGLIRYRNAQVARAVFSVLSAIAQLASAFFTGGATTGQAVAGAANAVNQVTGAVSSLQRVVTEFLVAMRDLVNAVNDIVQQVAPEVPALPDMPSEAEWAIFENEIEAAADEMPEEVSERLQWRAKCKNVAALGREMVTLATVIGQLQYDIKVHELLQEVAQNHAERLEAIQPVDLKNYQEMATELDMRTTRMILGLLEVLSLQNAALHYQFLLPPSPVTTARWTLLLQHEAAAVISLRICDRPRGDVCCQGHTRWLAARWGGLGDGEDWDFPISVRDAEDFPSGWSRVRISYVEMKFVRAGTGSDEEVHQPTTDTGKVYMVLRGEQLFADRKRGASLKYEAATPVEYQNAYRLVTGVGSSSSCR

SEQ ID NO: 312 - protein, 575 aa, Polystichum polyblepharum; identical to SEQ ID NO: 311

SEQ ID NO: 313 - protein, 609 aa, Polystichum tripteron
FIFYFFFHVQTAHNSPQLIKAVTRHVEWLNKMLVQLASPNDDILALLFRAQAYMKMAKQPHPVVPRLRYSMYSGLINRMVQIAQSYDDELKQLKLFIAQNEILGSYLLQQNQAFAAKEKSMSVFHSQVVSLRRIELDNAIEKMNRLSYQMDVEREEMEQARKDMEQALDDYEKKQIANAVFAVLGAIASAALGFVTGGATVAGAVAAAATAVGAIAKLAAMLNKVMGILEIVQQVVETVAALKEVVESINNIGHLVDAPEMPEMPSNADWLIFVNEMEAAADELPAEVGERTVWRAKCKNVAVLGQEMCTTGTHIAELQYQIKVEEMLQEIAERQAERLEGISSADLSSYMEMASQIDMRTTRLLLQLIKVLHIQSAALRYEYLYPASERLNSWPVSMETVWTMLLQQESSSLLGLLQLGVPNDATRTYVVKDIPVEVLQSGRDWPFVIPVDDYADFPSGWYRVRISHVELKIDQQAAGDANDIVIHQPSTATGKLYLLLQSSRFFSDRKPREVMEYEASMGLAYAYAYNLNTGEATLTNIPSSAYADTFMQMTPFTTWRLRLSASAEENQSLVFPTANSPTSTTQVSITFHLTRIRRIESRTFVGDVE

SEQ ID NO: 314 - protein, 721 aa, Polystichum tripteron
MGVPNHIMQLYKDMNQVSEAMRLDQMEFSEVMVIHRMYIKLEELDLGHLEGAEKVKRLYVFADMVEVGQSVVARLPGSFMVVILCRVLWLPDEGSTPFIMLPHLMKLRAVETSEPMQVPVGGDEMFLTGLGLFRAESDEEYPSLCIHAGVIQFSLRKVWSPSQRQFSIFNPHPPPTSTPLENIVFSSPYRKPDTRPVLRFFTSTFLNQRSQITTGPEYFTLDPASRAYTTLSIVTDPPVHWPPASVFDVNTLHPTFSVLDANIPDVLLTDDKILLAMQTSMLIAELVEVAHPASEDTRATTIAKHVEWLSGILLQALSKVEGSPSHYEYLALSFRAQYLIKTRRTTRRRVVPQLQYDIYSPVINRMAQIAETYDDSLRQFKLYIAQNQILGSYLLEQNRAFGAKERDLEVFHSELISQRENELRNTLIRMDDLSRQMDKQTAEMDKAKEEMEAGLRRFHSRTVANAMFGVLGAIGSIALGIFTGGATARRSARRAVSAAQEATRAANTLREVMRILERLEVVLEVVSILKELMESLQDLSTLVEAPEMPDLPTELDWNIFDNEIEGVAAQMPSEVSEVSAWKTKCKNVAVVGREMITTAAYISQLQYDIKEHSMLQEIAQRHADRLSAIKVADLSSYTEMVLQMEMRTARIMVSLIKVIHMQNAALMYQCLWPPTEVTTWPSLTIETAWIMLMQQEQSALLGLMRLGPSVGGEGHSCKPTA

SEQ ID NO: 315 - protein, 869 aa, Polystichum tripteron
MMMRPGFRTDVREDYEVIYAGSNSITREVGLSKVKCGEVMAIHRMFMRLDTLSQELLQQPELVKRLIVVADVVEIEGSGGILTLPGSFSVLIFCRLLILKRKDVVLDLGSWDLRVATTTPPLPRCSIRAQRVVIASSSPLASLLIQVKHELQWSNGSRFDQYFGRPFSFNSSEISSRSFPTTTTSTTSTKLAISTWPGTTPVSNFILVSSEKFNVLVNAVPWKGVIDCQAALPSLDDLMHPDVISGIQSTLLIVETILNYQTNNPTIILAAQQHVEWIVDSLLQVVHLPNSTTDVLELKTILARAQMLQKLPTDGSVQLRVPLLDYGEYQEDIDQLLINAAAYDQEYKELTRFVQQVQILGSEFLELSKNLAEKERQIETFESLAVIRKQNELDQAMRRIKTLQREIGRRSYEMAEARITMEEGLEDYKRRQLQNAVFGLLGALLQLFASVTFGGGAIDIAGAMATTVSAAIDTINLVEDSSASSKLLPMTQNLVDIEKVIEVVNAVNALVESATELEDIIHAPELPLISSYEWDIMENNIEELAALMPSEVSEVVTWKAKCRNLVAVCREICIAASFASEVQYELFVHARQQEMARRQAESLEQMQLASDLSAYVELATQADMRTTRLLLSLLNVLASHQGALYYHYLMEPEPFTFSWPSVDNVRMYLLELNHKARARESTLFGTGVLNVDMEQDYVVDSIPASLLLSGEDWNFTINPGRNASVFPVPWDYVRIRYVEIKFTGQHQPVTQTGEIYLLLKSSANFQDRFEDQVLEYEAAVPLVYQYAYNLGTGSTTVTNDPSTKGKFFRMTPFTHWKLRLSASAYQNEGVSFPTLLNAASDSPVQITITFYVTALPQIQHFSGGPTMEV

SEQ ID NO: 316 - protein, 852 aa, Polystichum tripteron
MEKDNPISGLGERSFYPPTPPVDSVTQAGNDLWLSFPGADKRDVYAHIYSNVNPIGTRAVSTPEPGKVVSVARIYLRLDQVIGHGADAAAGGIIQEMYIFADVIEIEGAKLNAEWEETVLGCHQYILLCNKLLADLTGIRRLQNLMRRVPLVVRLTNRHEPHLTMFTGRLFSPGAPVPHSSVVVHCNQFYCTDNNIINPNYVGLPPIPWAPRWALQHPSLLMAMESTITTSEVILHFIANTEGVDRLVEAMVSHVQWLNLTLLQALQERGTEQSAADLHELRMLFFRTQYLLKWPPGQISILVPRLHYTRFDNLIERMANVAEVYDRDFKQLTLFVAHNQAQGTYLFEQNKALAEREQDMEIAHSALYSMKEADLRRGIQNLETLGGQMQEMNAEMDQAREDMEAGLQRYRDQQIARAVFSILGAIAAIGVAILTGGIGARSALSRSKDAVNGVQTAVQTAARLKAVLKTVEKIVELVDVIWELKELIEEVADLAGMSLETPSRADLPEVPSAAEWYIFENEIEAVAADMPTEVSEVAVWKAKCKNVAALGREMTMQCVVVHELRYDIETHRLMAEVARSHADRLMSIQTFMDLTDYQRMATEIDMRTTRITLGLCKVLSLKHAAMRYEYLLPPSPLSITSFTISTIHSLLINQEVTAVAALNDLGIPTDHTITYLVRDIPIELLLDGEPWDFNIDSMADNLDFPSHWKRVRISHLQLHFTGARLPSTDTGAIYTLLESGSTFFDRGRPQLQEAIIQYEAMVPVAYQYAYDLQTGETTLSNKPSQQFANHFMRMTPFTQWRLRLPRTALENQGLCFPSPTPTPADATTQVSISFHLTAIRSRVHEHTVLRML

SEQ ID NO: 317 - protein, 675 aa, Polystichium tsus-simense
CNPASRLFHRRRHSPYSAGASTAAHSFAAATKSTFGAGTAGLIWTVSEVKKWYPSFKIVLPEVVPLQLLANSNIVLGVEVTALVSELIMTYQRQATELVAATLQHVDWLNTQLLSAQYSSGQLQALHFRVQALLKLLVGDDDAPLVVPPLQYEVYDDLINLMTSAAESYDNAFRQLNLFMQQNEILGSFLLDQNKAFSAKERDMESHHSQLVILQEAELTATNESIKSMNNELAQQNEAMDKAKADMEAGVKQYKDRLVAEAVFGVFRAIAQVCLAIFTGGASAAGAVETARKLSETAKALQSAVTHLEKLEKIVQVINSVTAFLENLQSLNQLIELPKMPDLPTEADWDMFENEVVAVAEGMPTEVSEVPMWKAKCKNVAALGREIIRTVAYMHQLQYDLAVNRMLQNIAQRQAERLEGLQIQDVDNYTEMATELDTRTNRMIMGLLKVLSLQTAALSYHYLLPPRSLTGWVNMDTVWNTLLNNKYDAVKALSSLGAAPTDTIQTYVVRDIPVGLLLEGNDWFFDIPIDDPAFPAPWFRVRIEHVELKFDPTSVHLPTTRNGQVYILLQAARFFADRVYGVVDEVLHFQATNTVHYQYAYRLDTGETTLNNRPTISSAAHYMRMTPFTRWRLRLSASAPQNEGLAFPTATTEDATTQITINFHLTGIHRIQYHA

SEQ ID NO: 318 - protein, 851 aa, Polystichium tsus-simense
MVDYGVVYAHVNEVGRRLGTGKVKCTRVLAKQGMLVRLDELTMEGLQDPYAVEQLVVFADVIEVAGTSVNFSAPIITIVCRILVLLDDSTRLDLTLPRAWNSLSNPARFSIFAQKVVSATPEPRRKSVVLQIRWRGSDMRGAEDVLPVSTAASDLGAEDVSPVSTAVPDLETAWGSIIFVLQGVPDAFRGRVEMNVLASLEVLLDPNVIISIQSTLLIAELILSYRTDLPETVQAAVEHAQWISNTLLAVCNFKCFHPYILHLPCTLMTMTITTCMAFTLMIFQVEASLNSSEEALELRNLLARAQMLLKFPTDGSQSLIIPRLEYRGYQSLIDRMAIVAESYTSELGQFMAFITQTQILLDDLVARTKAFAEKERDVADLQSSIVLRKRTELLQAEQTMMRLNDQLNKQAKDMEQAQHDMEQGLQEYKDREVARAFIGLLVAVVEVGVSFATGGLTALPAIKSSISAAKGLARLAEMIKAVIEVMERLAEAMEVLNAVRELIDAVAASKEIFEAPEMPDMPSIAEWDIFENEIELVAESMPEEVSEARVWRAKCKNVAAVCREVTRMGVYISQLQYELFVHAQQEAIARRHAERLEQIEAANLDNYLEMAMQIDMRTTRLLLGLLKMMSIQNAALQYHYLLPKEPFTGWPTIEIVRRRLIQKESQAVHGLEAMGMTTNFTRTFNVEDIPVDLLLSGEDWNFAIPPDSNSPFPLTFSRVRIRHVEMKFANTLALPSTTSGKLYILLQGSRTFHDRRFHEILEYEAAVPNAYPYAYNLSTGETTLSNEPSEHDAGNLLFFRMTPFTNWRLRLSSSAFENEGLLFPQGSTTTIIEITFHITAIRSIDTRLEVS

SEQ ID NO: 319 - protein, 886 aa, Pteris ensiformis
MEYSSLYGDVNQVSLRFQNTEFSEVMVVHRMHVRLEELDMTGVEGIEKVKRLYVLADVVELPSRATTVFEYVRLPATISAIILCRVLYIPEVQRLSGSAFVAQCSLDFPFMRLHVVGTSEGGAGVMQAFSSDAAASSIGVYLHADRFIYRQTTSTASDRVLPLDVRVSSGSSTFSTTARPDWPENLNVSFVTCGPQFLSKGPPLTSSDSDLQRSDEIELLDRQDGTPLLHVAFNPLAPGNVGGSQGRFQPSSACSFFHVPPPDVSADVLTDPSIILGMQMNMLIAELVLAAHNSPQVMNVVTKHVQWLNKILLQVASPNDDILALLFRIQAFMKMAKEPRFVVPRLQYHMYGSLINRMVQVAQNYDQEFRQLRLFIAQNKILGSYLLEQNRAFAEREREMSAFHLQVVSMRRSELRSAIETMNTLSLQMQTESEAMNEAQENMVEAIQEYERRLLARALFSVIGAIASVALAFATGGATAPGAVAAAGGAVSAAGRLAEGLQRVVDILQGLQTVMEVVVAIRDIVESLQNMGQLLEAPEMPEMPTNADWLIFVNEVEAVAEQVPTEVAEVPVWKAKCKNVAVLGQEMCTTGAYISELQYQITVEEMLQEIAQRQADRLVGISAADLSSYTEMASQIDMRTTRILLELIKMLYIQNAAIKYEYLYDANEKLNSWPVSMETVWTMLLHQENAALLGLLNLGPANDFTVTYAVKGIPVKLLVDGYDWNFEILVEDFAIFPSGWSRVRIRYVELKFDQQGTDSSNILIHQPSTNTGLVYMLLQGSRFLHDRKRGEVMDYEASMGPVYAYAYDLHTGATTLTNIPSQEYANTFMQTTPFNAWRLRLSASAMENQGLVFPTATSADSTTQISITFYVTAIRRIDHRQEGNVE

SEQ ID NO: 320 - protein, 878 aa, Cyathea cooperi
MEYSSLYSNPSLVNPNFQATEFSEVMVVHRMHVSLSHLNINTANSLLQPTLLQGSDKVKRLFIVADVVEAPTSRVFLPASLSVVVLCRLLYVTVPPPAFDTFGPAVTLTFPFMRFFVNEAIADFFPSKDDDAGIGCYIHADRIIRRLAMPQSDLRLRLIMTAEGPSTFSRDNWPISHFRFTQETVTADEPVAMADSELQRSDEYQQKDATVQFPLAVITFNPWLPPNGISDMGRGLDTTRPPVFCYFQFRSDVPSHILSNPYIVLGMQMTMLFAELVQVAHNSPHLLKLVTKHVEWLDKLLHQVTSPNDDILGLLFRVQVFKRTSERRHFLVPMLQYHMYSNLINRMVQAGEAYDRDLRNLQFFIATNQILGNYLLQQNKAFAEKEREMSGFHSNVVEMRRDELRNALDKMDLLALQMERENQAMQEARDALDKAILEYQRRLMANAILSVVRAVVSVALAFATAGATLAGAVASAGQAVSAAGQAAASLNKVVATLQALEGVMTFVIALREVVDSLGNMNNLINAPEQPELPSDADWLIFVNEIEAVAGQMPEEVVGPVSVWQSKCKNVAVLGQEMCTTTAHIGELTHQIKVEEMLQGIAQRQADRLNAISSPQDLSSFTEMLSEIDMRSLRLLLQLIRLLYIQNPALKYEYLFTTTDYLDTWPVNMETVRNVLIQQEAQAIRGLLQLGPSNDHTLTYVVKGIPVGLLVEGHDWVFSIPVQDFDAFPEGFSRVRIRYAELKFDAADQQTEGGMIHLPSTNTGLLYLLLQCSPSFADRKQQEVLDYEATSGVAYAYAYNLHTGAPTLTNIPSPEFANTFMRMTPFNTWRVRLSASAPENQGLSFLTANSPDDTTQITITFHFSAVRRIHHDPSQGTPI

SEQ ID NO: 321 - protein, 882 aa, Onoclea sensibilis
MEYSDLYADVNQVSMRFRETEVSEVMVVHRMHVRLQDLDMNGMPTNYSTVRRLYVVADVVELPSIVSNWMRFPGSLSVVILCRVLYVRDFNSVLGSCSLNFNFMRLRIVETKLGSVNVFPVPASASEDANNIGVYIHADRVIFRQDTSSSNIVRPVQLFVLGGSTFSTEVRPDWPTSLEVISIHLWPTLSKGQPISAAESDLQRSDEFELLPSPVGPDKVSIFFPSANPAPGNVIGQVLDVENIGAAFAFFHLPPLDPVPTEVLTDPYIISGLQMNMLIAELVLAAHNSPRVIKVVTKHVEWLNKMLQPKLHAAKDDILALLFRVQSFLKMAKEPRSVVPRLQYHMYSNLINRMVQVAQAYDQEFKQLQLFIVQNQILGRYLLEQNRAFASRERDMSSLHTQVVALRRTELNNAIDKMDLLSVQMERENEAMDQAKEDMMQAIEDYERRQVANALFAVLGAIASVALAFATAGATAPGAVAAAGAAVSAAGRLAEGLKRVVEILQGLEAVMEIVAAIRHLVESLQNIGSLIDAPAMPAGMPSDADWLIFVNEVEAVAEQMPAEVVGSVAVWKAKCKNVAVLGQEMCTTGAHIGELTYQIKVEEMLKDIAERQANRLEGITAADLSSYTEMLSQIDMRTTRLMLQLIRVLHIQNAAVKYEYLYDASRQLDSWPVSMETVWRLLLQQESDAITGLLSLGPSTDFTRSFVVKDVPVGLLLDGNDWQFVIPVEDSVAFPIGFSRVRIRYVELRFEQGSNDDGAAIHQPRTDSGSIYLLLQSSPFFSDRRRSAILDYEASMGLAYAFAYNLTTGVPTLTNVPSQEYANTFMRMTPFNNWRLRLSSSAEENRGLAFPTATSPDDRTQITLTFYITAIRGIDTRVLADE

SEQ ID NO: 322 - protein, 870 aa, Onoclea sensibilis
THFLECVGYWALCWRHQFPQPTCTIMGNVMTGPSYEEIYKNANYIHRSVATPICSEVMSVSRMYLALSELDVQRLKNPEIVKELYVFADVIFWDVFPTWPGLEAVFILCRVLVVDTRHLVAPSASSDGAEAAAADASVSIRAPWLNAPSTTFLISRREQIMPPFSCSIRAKHSTTRASTAPAAFCLQTEQVIDTSFSTNSAVSDNIVLKLETREGSSADDETVDDHIRESFPEVTLSWADVNLTLLWAMEATVLVAELISTYMSSSTRTVKEATLHLKWVNQLLIHALETKDGAPDAAVERLFNTLVLQVQLLLNNPSLVAGIVVPRLQYSTYRNLISTMAHMADGYTREFQQLIMFMEQNEVLGTFLLEQNQAFAAKERDMESFHAELHKVKTNDLIQALATLEQLEVLMTEMNAEMEQAQQDMEEGLRRFRNRQVARAVFSVFRSIVAIASSFFTGGATAGAAVQSTKNAVDQVVEMKSSLERIVETLEKLLLVSDFLVAMKELINAVQDVHGVAANVPTLPDMPTEAEWTIFENEIEAVAAEMPEEVSEVLVWKTKCKNMAAIGREMVTMATVISQLQYDVRMHDLLQEISRNQAERLEAIKPVDIRNYQEMATQLEMRTTHILLGLLEVLSLQNAAIQYQYLMPPSPVIMNNTIITMSDVWTQLLQQEAAAVVALSDLGFPTDRKVTYVVEGIPVGVLLDGQDWDFSISTEDVDHFPFGWSRVRIAYVEMKFVSARLGRSTEPAGNEDQIHEPITDTGEVYMILRGEQTFADRKRGEKVKYEAVAPVKYQYAYHVETGEMTEHNRPTEEFANHFMRMTPFTRWKLRMSGSARENRGLAFPTATAMDATTQIAIHFHVTAIRAADWH

SEQ ID NO: 323 - protein, 889 aa, Onoclea sensibilis
MARSAEAADAWREVYRDLNQVSERMRLDQLEFSEVMVIHRMHIKMSELDLGHLPGAEKVERLYVFADVVECDTPPYHSWSGPDLVIRLPGSMSVTFMCRVWHINHGVSQLQSFLDAKTLVLQIGHMRWHFNQTTGSMHRLDPQTLQNSPEPCFCVYAEVVRVAFYPDVTFPEFNNSPDLQFLQLQFGSDQLRFTSQTTNQPVWAIRGSLTFSMIPDNDGLLNEVSSQPAGTSFVLNMPDNLNVQLYANLNATSGTTLSRDPDSIIPAFSVLREKAVELLTDPNILPAMQTSMLIGELVEVGHPSEATLEVVRKHVEWLNHLLLQVIEAKQGQDVQDYIELSFRAQYVIKKVGRIHRPVVPQLQYNAYSNLINRMAQVAESYDQALRQFRIFIEQNKVLGGFLLEQNRAFAEKEADMDVFYSELITQRQIELDNTLQKMEHLGSQMDTQRADMEQAQADMEAGIRRFQDEQVARGLFAVLGAIAAVGLTVLTGGAAAPIALTAARRAVTLAGAVAQGLQRVLDILEGLQAVMEVIELIKDLISSLQELGQAVELPEMPEMPLDSDWLIFVNEVEGVAEQMPTEVSEVVAWKTKCKNVAVLGREMTTLAAYISQLQYDIKMQNMLQRIARKQADRLSAIQLPDLKNYAELVTQMDMRTTRLLVALIKVVYIQNAALMYQYLSEPTPVYAWPVNMDTVWRMLVQHEQFAVQGLMRLGPAFDIVRTYVVKSIPVSLLLEGDDYEFEILAEDHITFPLSLSRVRIHHLEMKFVQGGADVHMPITDTGSIYILLQGSRSFHDRNESAIIHYEAATSLDYHFAYRLDTGETTVTNLPSAEFVQTFMRMTPFSNWRLRLSASAEENKGLAFPTATSADATSHVAVTFFISAIRQVSL

SEQ ID NO: 324 - protein, 845 aa, Onoclea sensibilis
MGNVMTGPSYEEIYKNANYIHRSVATPICSEVMSVSRMYLALSELDVQRLKNPEIVKELYVFADVIFWDVFPTWPGLEAVFILCRVLVVDTRHLVAPSASSDGAEAAAADASVSIRAPWLNAPSTTFLISRREQIMPPFSCSIRAKHSTTRASTAPAAFCLQTEQVIDTSFSTNSAVSDNIVLKLETREGSSADDETVDDHIRESFPEVTLSWADVNLTLLWAMEATVLVAELISTYMSSSTRTVKEATLHLKWVNQLLIHALETKDGAPDAAVERLFNTLVLQVQLLLNNPSLVAGIVVPRLQYSTYRNLISTMAHMADGYTREFQQLIMFMEQNEVLGTFLLEQNQAFAAKERDMESFHAELHKVKTNDLIQALATLEQLEVLMTEMNAEMEQAQQDMEEGLRRFRNRQVARAVFSVFRSIVAIASSFFTGGATAGAAVQSTKNAVDQVVEMKSSLERIVETLEKLLLVSDFLVAMKELINAVQDVHGVAANVPTLPDMPTEAEWTIFENEIEAVAAEMPEEVSEVLVWKTKCKNMAAIGREMVTMATVISQLQYDVRMHDLLQEISRNQAERLEAIKPVDIRNYQEMATQLEMRTTHILLGLLEVLSLQNAAIQYQYLMPPSPVIMNNTIITMSDVWTQLLQQEAAAVVALSDLGFPTDRKVTYVVEGIPVGVLLDGQDWDFSISTEDVDHFPFGWSRVRIAYVEMKFVSARLGRSTEPAGNEDQIHEPITDTGEVYMILRGEQTFADRKRGEKVKYEAVAPVKYQYAYHVETGEMTEHNRPTEEFANHFMRMTPFTRWKLRMSGSARENRGLAFPTATAMDATTQIAIHFHVTAIRAADWH

SEQ ID NO: 325 - protein, 885 aa, Thelypteris noveboracensis
MEYSVLYGNVNQVSLRFEKTEFSEVVVVHRMHVRLAELNVTLGDTLLQGSDRVKRLYVLADVVEVPPNFSTWMSLPGTVSVVILCRILYFPYLEDASFASGWVVHAPLLRLRVVQTSTDFAQVFAIPENDSSAAAVADIGLYIHADRIIYRDDPARNIPVIEVQVRGNSTFSPYLPGFPDTGVKLSTVQCVREFSKGQPLAPEDSDLQRSDEIELIAPSGSEQRRLTAAFGDSTVVGVSLLFDPSTSFDFLSLGPSQINVPAAILSDPNIILGMQMNMLIAELVLAAHNSPQLIKAVTRHVEWLNKMLVQLASPNDDILGLLFRVQAYKKMAKQPHPVVPQLRYRMYQDFINRMVQIAQSYDGDLKQLKLFIAQNEILGSYLLEQNKAFAAKEKSMSAFHDQVVSLRKSELVNAIDKMNRLSYQMDVEREAMDQAQKDMEQGLEEYEKRQIVNAFFAVITAISLAALGFVTGGATVAGAVAAAGQAVNAVASLAATLQKVMGILQIIQQVVETVAAIREVIELFDNMGQLVAAPEMPEMPSNADWLIFVNEVEAMAEQLPVEVDARIVWKTKSKNVAVLGQEMCTIGTHIAELQYQIKVEEMLQKIAETQAERLEGISPADLSSYMEMVSQIDMRTTRLLLQLIRVLHIQNAALKYEYLYAADEQLDSWPVTMDTVWTMLLQQESASLSGLLSLGPANDDTRTYVVKDIPVEVLLSGGDWPFVIPVDDYTVFPAGWFYVRIRHVELKFEQQAGSDQNDIVIHQPSTNTGKLYMLLQSSRFFQDRNQAGVVMDYETSTGLSYPYAYNLNTGETTHQNVPSSEYAFTYMQMTPFTTWRLRLSAAAEENEGLVFHPPPTSPTSTTQISITFHVSRIRRIEYTLAGDVE

SEQ ID NO: 326 - protein, 896 aa, Thelypteris noveboracensis
MAAADDWSEVYRDLNQVSDRIRLDQLEFSEVMVIHRMHIKMSELDLGHLEGAEKVKHLYVFADVVEYDSLDAGLPGSIVRLPGSISVVIMCRVWHVSSLLIARPDLNNPQYVRSQDGVKLQLVHMKLYLNLVTNSMHRLDPQTLQEVPEPCLCVYAHVLRVAFRPDAGDSWDPALLFPAEYVLSTLEALIYDNDTPEHLLFNNSTFSRVWASRFQAIFRFINRDGLQIGSLPPGTIVTLNRDEPSLFSNAYRVNSTSLLNWTTISDVDWLAPAFSILRQRDIPVAVLTDPNILPAMQTSMLIGELVELGHPSAATIEVVDKHVKWLSNLWLQVIEEKKGKDVEEYLELLFRAQYVIKKVGRIRGLVVPQLQYDAYSNLINRMAQVAESYDQSLRQFRLFIQQNKILGRFLLEQNQAFAEKEKDMDIFYSELITQRQIELDNTLQKMKRLGSQMETQTAYMEQAQEDMEEGIRKFQNEQVARAIFGVIGVIAAVGLAFLTGGATAPAALGAARNAVTLAGTVAQTLQKVLDILEGLQAVMEIVAVINELVSSLQDLGQLLDLPEMPEMPMESDWLIFVNEVEAVAEQMPTEVSETIAWKTKCKNVAVLGREMITSATYISQLQYDIKVQSMLQQIAKKQADRLSNIQLPDLTNYTEMITQMDMRTTRMLVALIKVVYIQNAALMYQYLSEPTPVNAWPVNMETVWRMLVQHEQLAVQGLMRLGPAYDIVRTYVVEGIPVSLLLDGDDWEFEIPAEDRITFPLSLSRVRIHHLEMKFVQGANVHMPITDTGSIYILLQGSRNFHDRNEGEIIHYEAATSLEYHYAYRLDTGETTVTNLPSAEFVKTFMRMTPFTNWRLRVSASAEENKGLAFPLATSADATTQIAITFFISAIRQISL

That which is claimed is:

1. A recombinant PtIP-50 polypeptide comprising an amino acid sequence having at least 95% sequence identity, across the entire length of the amino acid sequence, compared to the amino acid sequence of SEQ ID NO: 71, wherein the PtIP-50 polypeptide has insecticidal activity against Soy Bean Looper, Corn Earworm, European Corn Borer or Velvet Bean Caterpillar in combination with a PtIP-65 polypeptide comprising an amino acid sequence having at least 95% identity to SEQ ID NO: 22, wherein the PtIP-50 polypeptide is operably linked to a heterologous signal or leader sequence.

2. The recombinant PtIP-50 polypeptide of claim 1, wherein the PtIP-50 polypeptide further comprises one or more characteristic selected from the group consisting of:
   a) a molecular weight of between about 80 kDa and about 100 kDa;
   b) an isoelectric point between about 4.4 and 5.2; and
   c) does not have chitinase activity.

3. A recombinant PtIP-50 polypeptide comprising an amino acid sequence having at least 95% sequence identity, across the entire length of the amino acid sequence, compared to the amino acid sequence of SEQ ID NO: 71, wherein the PtIP-50 polypeptide has insecticidal activity against Soy Bean Looper, Corn Earworm, European Corn Borer or Velvet Bean Caterpillar in combination with a PtIP-65 polypeptide comprising an amino acid sequence having at least 95% identity to SEQ ID NO: 22, and the PtIP-50 polypeptide, in combination with the PtIP-65 polypeptide, specifically binds to brush border membrane vesicles isolated from Soy Bean Looper.

4. The recombinant PtIP 50 polypeptide of claim 1, wherein A recombinant PtIP-50 polypeptide comprising an amino acid sequence having at least 95% sequence identity, across the entire length of the amino acid sequence, compared to the amino acid sequence of SEQ ID NO: 71, wherein the PtIP-50 polypeptide has insecticidal activity against Soy Bean Looper, Corn Earworm, European Corn Borer or Velvet Bean Caterpillar in combination with a PtIP-65 polypeptide comprising an amino acid sequence having at least 95% identity to SEQ ID NO: 22, and the PtIP-50 polypeptide, in combination with the PtIP-65 polypeptide, disrupts the ionic balance across brush border membrane vesicles isolated from Soy Bean Looper.

5. A polynucleotide encoding a PtIP-50 polypeptide comprising an amino acid sequence having at least 95% sequence identity, across the entire length of the amino acid sequence, compared to the amino acid sequence of SEQ ID NO: 71, wherein the PtIP-50 polypeptide has insecticidal activity against Soy Bean Looper, Corn Earworm, European Corn Borer or Velvet Bean Caterpillar in combination with a PtIP-65 polypeptide comprising an amino acid sequence having at least 95% identity to SEQ ID NO: 22, wherein the polynucleotide encoding the PtIP-50 polypeptide is operably linked to a heterologous regulatory element.

6. A fusion protein comprising:
a PtIP-50 polypeptide comprising: an amino acid sequence having at least 95% sequence identity, across the entire length of the amino acid sequence, compared to the amino acid sequence of SEQ ID NO: 71, wherein the PtIP-50 polypeptide has insecticidal activity against Soy Bean Looper, Corn Earworm, European Corn Borer or Velvet Bean Caterpillar in combination with a PtIP-65 polypeptide comprising an amino acid sequence having at least 95% identity to SEQ ID NO: 22; and
a polypeptide selected from:
  a) a PtIP-65 polypeptide comprising an amino acid sequence having at least 95% sequence identity, across the entire length of the amino acid sequence, compared to the amino acid sequence of SEQ ID NO: 22;
  b) an insecticidal polypeptide having a different mode of action from the PtIP-50 polypeptide; and
  c) a polypeptide to increase expression, facilitate purification or detection.

* * * * *